United States Patent 11,446,398 (REGULATED BIOCIRCUIT SYSTEMS) - sequence listing, part 40

SEQ ID NO: 127570 - DNA, 909 bp, Homo sapiens
  Payload ID: 4964
  Gene Symbol: DMAP1
  Gene Name: DNA methyltransferase 1 associated protein 1
  ENST ID: ENST00000440641
  CDS Start-End: 198-909
gccgcggctttgcggggacgggggagtggtagtgggggctgcagctgccggacccaggtgcggaagtgcgagggcccaggtggctgaaggggccgttaggaacatccaagcggtggggcacaggcagatccccgacctgacctggaccacccttctcctcttggcccgccccttcaactcgcctccgcttaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccc

SEQ ID NO: 127571 - DNA, 957 bp, Homo sapiens
  Payload ID: 4964
  Gene Symbol: DMAP1
  Gene Name: DNA methyltransferase 1 associated protein 1
  ENST ID: ENST00000437511
  CDS Start-End: 101-957
cgcggctttgcggggacgggggagtggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaacaagggctcctgcttgcttagcaggatgcaggaggacctgaagtcttttgctccaggacatgactttcttgctataggggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaagga

SEQ ID NO: 127572 - DNA, 1066 bp, Homo sapiens
  Payload ID: 4964
  Gene Symbol: DMAP1
  Gene Name: DNA methyltransferase 1 associated protein 1
  ENST ID: ENST00000446292
  CDS Start-End: 161-1066
ccggaagtttctgccgcggctttgcggggacgggggagtggtagtgggggctgcagctgccggacccaggtctggattggccccgccccctgacctgagcctggtccttcttcaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccg

SEQ ID NO: 127573 - DNA, 1972 bp, Homo sapiens
  Payload ID: 4965
  Gene Symbol: DNTT
  Gene Name: DNA nucleotidylexotransferase
  Uniprot ID: P04053
  ENST ID: ENST00000371174
  CDS Start-End: 103-1632
gtgagatgacatcaaaacccttcgtgtaggagggtggcagtctccctcccttctggagacaccaccagatgggccagccagaggcagcagcagcctcttcccatggatccaccacgagcgtcccacttgagccctcggaagaagagaccccggcagacgggtgccttgatggcctcctctcctcaagacatcaaatttcaagatttggtcgtcttcattttggagaagaaaatgggaaccacccgcagagcgttcctcatggagctggcccgcaggaaagggttcagggttgaaaatgagctcagtgattctgtcacccacatcgtagcagagaacaactcgggttcggatgttctggagtggcttcaagcacagaaagtacaagtcagctcacaaccagagctcctcgatgtctcctggctgatcgaatgcataagagcagggaaaccggtggaaatgacaggaaaacaccagcttgttgtgagaagagactattcagatagcaccaacccaggccccccgaagactccaccaattgctgtacaaaagatctcccagtatgcgtgtcagagaagaaccactttaaacaactgtaaccagatattcacggatgcctttgatatactggctgaaaactgtgagtttagagaaaatgaagactcctgtgtgacatttatgagagcagcttctgtattgaaatctctgccattcacaatcatcagtatgaaggacacagaaggaattccctgcctggggtccaaggtgaagggtatcatagaggagattattgaagatggagaaagttctgaagttaaagctgtgttaaatgatgaacgatatcaatccttcaaactctttacttctgtatttggagtggggctgaagacttctgagaagtggttcaggatgggtttcagaactctgagtaaagtaaggtcggacaaaagcctgaaatttacacgaatgcagaaagcaggatttctgtattatgaagaccttgtcagctgtgtgaccagggcagaagcagaggccgtcagtgtgctggttaaagaggctgtctgggcatttcttccggatgctttcgtcaccatgacaggagggttccggaggggtaagaagatggggcatgatgtagattttttaattaccagcccaggatcaacagaggatgaagagcaacttttacagaaagtgatgaacttatgggaaaagaagggattacttttatattatgaccttgtggagtcaacatttgaaaagctcaggttgcctagcaggaaggttgatgctttggatcattttcaaaagtgctttctgattttcaaattgcctcgtcaaagagtggacagtgaccagtccagctggcaggaaggaaagacctggaaggccatccgtgtggatttagttctgtgcccctacgagcgtcgtgcctttgccctgttgggatggactggctcccggcagtttgagagagacctccggcgctatgccacacatgagcggaagatgattctggataaccatgctttatatgacaagaccaagaggatattcctcaaagcagaaagtgaagaagaaatttttgcgcatctgggattggattatattgaaccgtgggaaagaaatgcctaggaaagtgttgtcaacatttttttcctattcttttcaagttaaataaattatgcttcatattagtaaaagatgccataggagagtttggggttatttaggtcttattgaaatgcagattgctactagaaataaataactttggaaacatgggaaggtgccactggtaatgggtaaggttctaataggccatgtttatgactgttgcatagaattcacaatgcatttttcaagagaaatgatgttgtcactggtggctcattcagggaagctcatcaaagcccactttgttcgcagtgtagctgaaatactgtctatctctaataaaaacaggaggaaacaa

SEQ ID NO: 127574 - DNA, 1954 bp, Homo sapiens
  Payload ID: 4965
  Gene Symbol: DNTT
  Gene Name: DNA nucleotidylexotransferase
  Uniprot ID: P04053
  ENST ID: ENST00000630152
  CDS Start-End: 90-1616
aaaacccttcgtgtaggagggtggcagtctccctcccttctggagacaccaccagatgggccagccagaggcagcagcagcctcttcccatggatccaccacgagcgtcccacttgagccctcggaagaagagaccccggcagacgggtgccttgatggcctcctctcctcaagacatcaaatttcaagatttggtcgtcttcattttggagaagaaaatgggaaccacccgcagagcgttcctcatggagctggcccgcaggaaagggttcagggttgaaaatgagctcagtgattctgtcacccacatcgtagcagagaacaactcgggttcggatgttctggagtggcttcaagcacagaaagtacaagtcagctcacaaccagagctcctcgatgtctcctggctgatcgaatgcataagagcagggaaaccggtggaaatgacaggaaaacaccagcttgttgtgagaagagactattcagatagcaccaacccaggccccccgaagactccaccaattgctgtacaaaagatctcccagtatgcgtgtcagagaagaaccactttaaacaactgtaaccagatattcacggatgcctttgatatactggctgaaaactgtgagtttagagaaaatgaagactcctgtgtgacatttatgagagcagcttctgtattgaaatctctgccattcacaatcatcagtatgaaggacacagaaggaattccctgcctggggtccaaggtgaagggtatcatagaggagattattgaagatggagaaagttctgaagttaaagctgtgttaaatgatgaacgatatcaatccttcaaactctttacttctgtatttggagtggggctgaagacttctgagaagtggttcaggatgggtttcagaactctgagtaaagtaaggtcggacaaaagcctgaaatttacacgaatgcagaaagcaggatttctgtattatgaagaccttgtcagctgtgtgaccagggcagaagcagaggccgtcagtgtgctggttaaagaggctgtctgggcatttcttccggatgctttcgtcaccatgacaggagggttccggaggggtaagaagatggggcatgatgtagattttttaattaccagcccaggatcaacagaggatgaagagcaacttttacagaaagtgatgaacttatgggaaaagaagggattacttttatattatgaccttgtggagtcaacatttgaaaagctcaggttgcctagcaggaaggttgatgctttggatcattttcaaaagtgctttctgattttcaaattgcctcgtcaaagagtggacagtgaccagtccagctggcaggaaggaaagacctggaaggccatccgtgtggatttagttctgtgcccctacgagcgtcgtgcctttgccctgttgggatggactggctcccggtttgagagagacctccggcgctatgccacacatgagcggaagatgattctggataaccatgctttatatgacaagaccaagaggatattcctcaaagcagaaagtgaagaagaaatttttgcgcatctgggattggattatattgaaccgtgggaaagaaatgcctaggaaagtgttgtcaacatttttttcctattcttttcaagttaaataaattatgcttcatattagtaaaagatgccataggagagtttggggttatttaggtcttattgaaatgcagattgctactagaaataaataactttggaaacatgggaaggtgccactggtaatgggtaaggttctaataggccatgtttatgactgttgcatagaattcacaatgcatttttcaagagaaatgatgttgtcactggtggctcattcagggaagctcatcaaagcccactttgttcgcagtgtagctgaaatactgtctatctctaataaaaacaggaggaaac

SEQ ID NO: 127575 - DNA, 2314 bp, Homo sapiens
  Payload ID: 4966
  Gene Symbol: DSCC1
  Gene Name: DNA replication and sister chromatid cohesion 1
  Uniprot ID: Q9BVC3
  ENST ID: ENST00000313655
  CDS Start-End: 216-1397
gcgtggggcacggaggggctcgcgctcccagaagccggcaggccttcccgcgggcgggcccgcagcgcgctccgccccggaaacacgcccatggccgccttggcgcgctttcaaacgctcaggtttcctaccttccggctgcttgggaacttctttcttgcccgccaagcccgcagccacccgggcgcggcgggactcctagacccggcgctgcgatgaagaggacccgcgacgaggtggatgcgacgctgcagatcgccaagctgaatgcggccgagctgctgccggcggtgcactgcctgggcttcggccctggggccagcggcgctgcagccggcgacttctgcctgctggagctggagcccacgctgtgccagcagctggaggatggacacagtcttgtgattcgtggtgataaagacgagcaagctgtgctgtgcagtaaagacaaaacatacgacttgaagatagcagacacttccaatatgttgcttttcattcctggttgtaaaactccggaccagttgaagaaggaagattcacactgtaacattattcacactgagatctttggtttttctaataattattgggaattaagaagacgtagacccaagttaaagaagctaaagaaacttttgatggaaaatccatatgaaggacctgacagtcaaaaagagaaggattcaaatagctcaaaatatacaactgaagatttgcttgatcaaattcaggcaagtgaggaagaaataatgacccaattacaagttctaaatgcctgtaagattggaggttattggaggattcttgaatttgattatgagatgaaacttctgaatcatgtaactcagcttgtggattctgaatcatggtcttttggtaaagttcctttgaacacatgccttcaggaactcggaccattggagccagaggaaatgatagaacactgtcttaaatgttatgggaagaaatatgtagatgaaggcgaagtttattttgagttggatgctgataaaatatgtagagcagcagcacgaatgctacttcagaatgcggtgaaattcaatctcgctgagtttcaagaagtgtggcagcagagtgttcctgaaggaatggtaactagtcttgatcagcttaagggtttagcgctggtggatagacactcgagaccagaaatcatatttttgctgaaagtagatgatttacctgaggataatcaggaacgttttaatagccttttctctctaagggagaagtggacagaagaagatattgctccatatattcaagatttgtgtggagagaagcaaaccataggtgcattactcactaaatattctcattcttcgatgcaaaatggtgttaaagtttataattcgagaagacccatttcttaaaagaacaacggtcttttcttcaggactcaagttgctttataaagttgctggatagaagaaaaataacttgtacttttatttctgacttttagaaacctagtcttctaaggcatttttctcctcatcttaagcattttgaaactactgttatttcttaaatgttataggatgtagctttaaaattatatttgtactatgtacacagtgtaaacaaggacaaaagaattctttcctatattatgtctgaggtctctatgatttatttaaagtttggctttttatatttaaaatgtcatttctttacttaggatttgatgttctaatcattaatacacttaagttttccagagaactaaatagtaatagtttcatagaagagaactatttattcacttaaatatcatttctcaagtgagtgagttcccctctacttttagccttccacccaaactggaagcctctaggtgctatcaattatttatatccatcgtttacatccatgaaattggctgaataattactcctctgcctggcgtagacatgcgctttgggaaaaaaacgagtttataatcctataatgaagaatactggcacaggcaatgctcactcgaaaacttcaagtaatttctagttggttttggaatgcttgataaagttcctttacagctttattttcctgatttgttttggtttagatcaaagttcaaattaattttaacttagctaatgaactcatcaccaggacagttggagggggtaggccgaggttaaatggtccacgtttcaaaaatgttaatggctaatccataattaaagaaggtttaactgttactgaagtttacaagttttattgtcatgaacatgaaatacaaacacgatggcttcgaaatgtctttcaataaatgtttctgcattta

SEQ ID NO: 127576 - DNA, 4208 bp, Homo sapiens
  Payload ID: 4967
  Gene Symbol: DNA2
  Gene Name: DNA replication helicase/nuclease 2
  Uniprot ID: P51530
  ENST ID: ENST00000358410
  CDS Start-End: 52-3234
ccccggttccgctgtcttttctgtctacagtttgcgatccccgcgtccaggatggagcagctgaacgaactggagctgctgatggagaagagtttttgggaggaggcggagctgccggcggagctatttcagaagaaagtggtagcttcctttccaagaacagttctgagcacaggaatggataaccggtacctggtgttggcagtcaatactgtacagaacaaagagggaaactgtgaaaagcgcctggtcatcactgcttcacagtcactagaaaataaagaactatgcatccttaggaatgactggtgttctgttccagtagagccaggagatatcattcatttggagggagactgcacatctgacacttggataatagataaagattttggatatttgattctgtatccagacatgctgatttctggcaccagcatagccagtagtattcgatgtatgagaagagctgtcctgagtgaaacttttaggagctctgatccagccacacgccaaatgctaattggtacggttctccatgaggtgtttcaaaaagccataaataatagctttgccccagaaaagctacaagaacttgcttttcaaacaattcaagaaataagacatttgaaggaaatgtaccgcttaaatctaagtcaagatgaaataaaacaagaagtagaggactatcttccttcgttttgtaaatgggcaggagatttcatgcataaaaacacttcgactgacttccctcagatgcagctctctctgccaagtgataatagtaaggataattcaacatgtaacattgaagtcgtgaaaccaatggatattgaagaaagcatttggtcccctaggtttggattgaaaggcaaaatagatgttacagttggtgtgaaaatacatcgagggtataaaacaaaatacaagataatgccgctggaacttaaaactggcaaagaatcaaattctattgaacaccgtagtcaggttgttctgtacactctactaagccaagagagaagagctgatccagaggctggcttgcttctctacctcaagactggtcagatgtaccctgtgcctgccaaccatctagataaaagagaattattaaagctaagaaaccagatggcattctcattgtttcaccgtattagcaaatctgctactagacagaagacacagcttgcttctttgccacaaataattgaggaagagaaaacttgtaaatattgttcacaaattggcaattgtgctctttatagcagagcagttgaacaacagatggattgtagttcagtcccaattgtgatgctgcccaaaatagaagaagaaacccagcatctgaagcaaacacacttagaatatttcagcctttggtgtctaatgttaaccctggagtcacaatcgaaggataataaaaagaatcaccaaaatatctggctaatgcctgcttcggaaatggagaagagtggcagttgcattggaaacctgattagaatggaacatgtaaagatagtttgtgatgggcaatatttacataatttccaatgtaaacatggtgccatacctgtcacaaatctaatggcaggtgacagagttattgtaagtggagaagaaaggtcactgtttgctttgtctagaggatatgtgaaggagattaacatgacaacagtaacttgtttattagacagaaacttgtcggtccttccagaatcaactttgttcagattagaccaagaagaaaaaaattgtgatatagataccccattaggaaatctttccaaattgatggaaaacacgtttgtcagcaaaaaacttcgagatttaattattgactttcgtgaacctcagtttatatcctaccttagttctgttcttccacatgatgcaaaggatacagttgcctgcattctaaagggtttgaataagcctcagaggcaagcgatgaaaaaggtacttctttcaaaagactacacactcatcgtgggtatgcctgggacaggaaaaacaactacgatatgtactctcgtaagaattctctacgcctgtggttttagcgttttgttgaccagctatacacactctgctgttgacaatattcttttgaagttagccaagtttaaaataggatttttgcgtttgggtcagattcagaaggttcatccagctatccagcaatttacagagcaagaaatttgcagatcaaagtccattaaatccttagctcttctagaagaactctacaatagtcaacttatagttgcaacaacatgtatgggaataaaccatccaatattttcccgtaaaatttttgatttttgtattgtggatgaagcctctcaaattagccaaccaatttgtctgggccccctttttttttcacggagatttgtgttagtgggggaccatcagcagcttcctcccctggtgctaaaccgtgaagcaagagctcttggcatgagtgaaagcttattcaagaggctggagcagaataagagtgctgttgtacagttaaccgtgcagtacagaatgaacagtaaaattatgtccttaagtaataagctgacctatgagggcaagctggagtgtggatcagacaaagtggccaatgcagtgataaacctacgtcactttaaagatgtgaagctggaactggaattttatgctgactattctgataatccttggttgatgggagtatttgaacccaacaatcctgtttgtttccttaatacagacaaggttccagcgccagaacaagttgaaaaaggtggtgtgagcaatgtaacagaagccaaactcatagttttcctaacctccatttttgttaaggctggatgcagtccctctgatattggtattattgcaccgtacaggcagcaattaaagatcatcaatgatttattggcacgttctattgggatggtcgaagttaatacagtagacaaataccaaggaagggacaaaagtattgtcctagtatcttttgttagaagtaataaggatggaactgttggtgaactcttgaaagattggcgacgtcttaatgttgctataaccagagccaaacataaactgattcttctggggtgtgtgccctcactaaattgctatcctcctttggagaagctgcttaatcatttaaactcagaaaaattaatcattgatcttccatcaagagaacatgaaagtctttgccacatattgggtgactttcaaagagaataaaacactatttcccttgccttttcatactagggcagtatctcctctagctagtgcccatacagaaaattctatcaccatacaaaatttaatgcagtatttatgttttaaagcacaggtgtaccgaaaactgtgaaaagtctgaatttatgggttctatgcatgcatttttgcctaacctagagaaagagtttgataaatttttaccagctttgaagatggattaacttttgactttgagctttaaacttttaagtcagacatttcaggactaatttgattttgtagatatcattgtaagaactttatttgaaagactgaataaagggatttgatttgttttcatcatttaagcacagtcttgtgatgatgagaacataagtgtgattcttttctgtattttgaggtccctaatccaaagcccattttgctaggattttttctgctatcagatgtgttttcactctaaacctagtcttttatgacatgaattgattacttcctgttaattttctatcctcccttactatcctccttttttgttttcagtattcagtatttcagtattctagagtagattttgatataaaagaaaataattcttacatcatcttttgcaacaaattttgttttctgaattgataataaatttaaaaagttgattcctattttcacatatgttcatatgcccctatgtttgggggtatcactcagttttcccttttttgtgtaaagatgttttgtaaaacaaaattgtctcaaagtgattatattatatatataaaaagtaacagattttaacaaaggttaaaagattcttggggtaacagattcttctggggcttggaaatcttccatttctcttgagggttttttttaatgagtgttaaatatgttaaaatttttatttctacctcatgtgtttttttaaattattacttgaagttttttatttaataaattttttctactaatgg

SEQ ID NO: 127577 - DNA, 3207 bp, Homo sapiens
  Payload ID: 4967
  Gene Symbol: DNA2
  Gene Name: DNA replication helicase/nuclease 2
  Uniprot ID: P51530
  ENST ID: ENST00000399179
  CDS Start-End: 90-2153
tgaagactccctgtattcccagtcctaagcaagggagcaaaggcaggggacagagccctgctgctcagtttgcgatccccgcgtccaggatggagcagctgaacgaactggagctgctgatggagaagagtttttgggaggaggcggagctgccggcggagctatttcagaagaaagtggtagcttcctttccaagaacagttctgagcacaggaatggataaccggtacctggtgttggcagtcaatactgtacagaacaaagagggaaactgtgaaaagcgcctggtcatcactgcttcacagtcactagaaaataaagaactatgcatccttaggaatgactggtgttctgttccagtagagccaggagatatcattcatttggagggagactgcacatctgacacttggataatagataaagattttggatatttgattctgtatccagacatgctgatttctggcaccagcatagccagtagtattcgatgtatgagaagagctgtcctgagtgaaacttttaggagctctgatccagccacacgccaaatgctaattggtacggttctccatgaggtgtttcaaaaagccataaataatagctttgccccagaaaagctacaagaacttgcttttcaaacaattcaagaaataagacatttgaaggaaatgtaccgcttaaatctaagtcaagatgaaataaaacaagaagtagaggactatcttccttcgttttgtaaatgggcaggagatttcatgcataaaaacacttcgactgacttccctcagatgcagctctctctgccaagtgataatagtaaggataattcaacatgtaacattgaagtcgtgaaaccaatggatattgaagaaagcatttggtcccctaggtttggattgaaaggcaaaatagatgttacagttggtgtgaaaatacatcgagggtataaaacaaaatacaagataatgccgctggaacttaaaactggcaaagaatcaaattctattgaacaccgtagtcaggttgttctgtacactctactaagccaagagagaagagctgatccagaggctggcttgcttctctacctcaagactggtcagatgtaccctgtgcctgccaaccatctagataaaagagaattattaaagctaagaaaccagatggcattctcattgtttcaccgtattagcaaatctgctactagacagaagacacagcttgcttctttgccacaaataattgaggaagagaaaacttgtaaatattgttcacaaattggcaattgtgctctttatagcagagcagttgaacaacagatggattgtagttcagtcccaattgtgatgctgcccaaaatagaagaagaaacccagcatctgaagcaaacacacttagaatatttcagcctttggtgtctaatgttaaccctggagtcacaatcgaaggataataaaaagaatcaccaaaatatctggctaatgcctgcttcggaaatggagaagagtggcagttgcattggaaacctgattagaatggaacatgtaaagatagtttgtgatgggcaatatttacataatttccaatgtaaacatggtgccatacctgtcacaaatctaatggcaggtgacagagttattgtaagtggagaagaaaggtcactgtttgctttgtctagaggatatgtgaaggagattaacatgacaacagtaacttgtttattagacagaaacttgtcggtccttccagaatcaactttgttcagattagaccaagaagaaaaaaattgtgatatagataccccattaggaaatctttccaaattgatggaaaacacgtttgtcagcaaaaaacttcgagatttaattattgactttcgtgaacctcagtttatatcctaccttagttctgttcttccacatgatgcaaaggatacagttgcctgcattctaaagggtttgaataagcctcagaggcaagcgatgaaaaaggtacttctttcaaaagactacacactcatcgtgggtatgcctgggacaggaaaaacaactacgatatgtactctcgtaagattcagaaggttcatccagctatccagcaatttacagagcaagaaatttgcagatcaaagtccattaaatccttagctcttctagaagaactctacaatagtcaacttatagttgcaacaacatgtatgggaataaaccatccaatattttcccgtaaaatttttgatttttgtattgtggatgaagcctctcaaattagccaaccaatttgtctgggccccctttttttttcacggagatttgtgttagtgggggaccatcagcagcttcctcccctggtgctaaaccgtgaagcaagagctcttggcatgagtgaaagcttattcaagaggctggagcagaataagagtgctgttgtacagttaaccgtgcagtacagaatgaacagtaaaattatgtccttaagtaataagctgacctatgagggcaagctggagtgtggatcagacaaagtggccaatgcagtgataaacctacgtcactttaaagatgtgaagctggaactggaattttatgctgactattctgataatccttggttgatgggagtatttgaacccaacaatcctgtttgtttccttaatacagacaaggttccagcgccagaacaagttgaaaaaggtggtgtgagcaatgtaacagaagccaaactcatagttttcctaacctccatttttgttaaggctggatgcagtccctctgatattggtattattgcaccgtacaggcagcaattaaagatcatcaatgatttattggcacgttctattgggatggtcgaagttaatacagtagacaaataccaaggaagggacaaaagtattgtcctagtatcttttgttagaagtaataaggatggaactgttggtgaactcttgaaagattggcgacgtcttaatgttgctataaccagagccaaacataaactgattcttctggggtgtgtgccctcactaaattgctatcctcctttggagaagctgcttaatcatttaaactcagaaaaattaatcattgatcttccatcaagagaacatgaaagtctttgccacatattgggtgactttcaaagagaataaaacactatttcccttgccttttcatactagggcagtatctcctctagcta

SEQ ID NO: 127578 - DNA, 3207 bp, Homo sapiens; identical to SEQ ID NO: 127577
  Payload ID: 4967
  Gene Symbol: DNA2
  Gene Name: DNA replication helicase/nuclease 2
  Uniprot ID: P51530
  ENST ID: ENST00000399180
  CDS Start-End: 90-2153

SEQ ID NO: 127579 - DNA, 1172 bp, Homo sapiens
  Payload ID: 4967
  Gene Symbol: DNA2
  Gene Name: DNA replication helicase/nuclease 2
  ENST ID: ENST00000440722
  CDS Start-End: 1-1126
ctctgctgttgacaatattcttttgaagttagccaagtttaaaataggatttttgcgtttgggtcagattcagaaggttcatccagctatccagcaatttacagagcaagaaatttgcagatcaaagtccattaaatccttagctcttctagaagaactctacaatagtcaacttatagttgcaacaacatgtatgggaataaaccatccaatattttcccgtaaaatttttgatttttgtattgtggatgaagcctctcaaattagccaaccaatttgtctgggccccctttttttttcacggagatttgtgttagtgggggaccatcagcagcttcctcccctggtgctaaaccgtgaagcaagagctcttggcatgagtgaaagcttattcaagaggctggagcagaataagagtgctgttgtacagttaaccgtgcagtacagaatgaacagtaaaattatgtccttaagtaataagctgacctatgagggcaagctggagtgtggatcagacaaagtggccaatgcagtgataaacctacgtcactttaaagatgtgaagctggaactggaattttatgctgactattctgataatccttggttgatgggagtatttgaacccaacaatcctgtttgtttccttaatacagacaaggttccagcgccagaacaagttgaaaaaggtggtgtgagcaatgtaacagaagccaaactcatagttttcctaacctccatttttgttaaggctggatgcagtccctctgatattggtattattgcaccgtacaggcagcaattaaagatcatcaatgatttattggcacgttctattgggatggtcgaagttaatacagtagacaaataccaaggaagggacaaaagtattgtcctagtatcttttgttagaagtaataaggatggaactgttggtgaactcttgaaagattggcgacgtcttaatgttgctataaccagagccaaacataaactgattcttctggggtgtgtgccctcactaaattgctatcctcctttggagaagctgcttaatcatttaaactcagaaaaattaatatcctttttcttctgtatatggtcacatttgattgcactgttgtgagtatttatttgcttgtttaaattaaagctctcactatgttgcttaa

SEQ ID NO: 127580 - DNA, 543 bp, Homo sapiens
  Payload ID: 4967
  Gene Symbol: DNA2
  Gene Name: DNA replication helicase/nuclease 2
  ENST ID: ENST00000550357
  CDS Start-End: 23-142
gtttgcgatccccgcgtccaggatggagcagctgaacgaactggagctgctgatggagaagagtttttgggaggaggcggagctgccggcggagctaaccggggtctttttctgtcgctcaggaaggggtgcagtagcatgatcgtatctcactgcagcctcaaactcctgggctcaagcagtccttccacctcagcctcttgagtagctgggactacagatttcagaagaaagtggtagcttcctttccaagaacagttctgagcacaggaatggataaccggtacctggtgttggcagtcaatactgtacagaacaaagagggaaactgtgaaaagcgcctggtcatcactgcttcacagtcactagaaaataaagaactatgcatccttaggaatgactggtgttctgttccagtagagccaggagatatcattcatttggagggagactgcacatctgacacttggataatagataaagattttggatatttgattctgtatccagacatgctgatttctggcaccagcatagccagta

SEQ ID NO: 127581 - DNA, 3468 bp, Homo sapiens
  Payload ID: 4967
  Gene Symbol: DNA2
  Gene Name: DNA replication helicase/nuclease 2
  ENST ID: ENST00000551118
  CDS Start-End: 23-2626
gtttgcgatccccgcgtccaggatggagcagctgaacgaactggagctgctgatggagaagagtttttgggaggaggcggagctgccggcggagctatttcagaagaaagtggtagcttcctttccaagaacagttctgagcacaggaatggataaccggtacctggtgttggcagtcaatactgtacagaacaaagagggaaactgtgaaaagcgcctggtcatcactgcttcacagtcactagaaaataaagaactatgcatccttaggaatgactggtgttctgttccagtagagccaggagatatcattcatttggagggagactgcacatctgacacttggataatagataaagattttggatatttgattctgtatccagacatgctgatttctggcaccagcatagccagtagtattcgatgtatgagaagagctgtcctgagtgaaacttttaggagctctgatccagccacacgccaaatgctaattggtacggttctccatgaggtgtttcaaaaagccataaataatagctttgccccagaaaagctacaagaacttgcttttcaaacaattcaagaaataagacatttgaaggaaatgtaccgcttaaatctaagtcaagatgaaataaaacaagaagtagaggactatcttccttcgttttgtaaatgggcaggagatttcatgcataaaaacacttcgactgacttccctcagatgcagctctctctgccaagtgataatagtaaggataattcaacatgtaacattgaagtcgtgaaaccaatggatattgaagaaagcatttggtcccctaggtttggattgaaaggcaaaatagatgttacagttggtgtgaaaatacatcgagggtataaaacaaaatacaagataatgccgctggaacttaaaactggcaaagaatcaaattctattgaacaccgtagtcaggttgttctgtacactctactaagccaagagagaagagctgatccagaggctggcttgcttctctacctcaagactggtcagatgtaccctgtgcctgccaaccatctagataaaagagaattattaaagctaagaaaccagatggcattctcattgtttcaccgtattagcaaatctgctactagacagaagacacagcttgcttctttgccacaaataattgaggaagagaaaacttgtaaatattgttcacaaattggcaattgtgctctttatagcagagcagttgaacaacagatggattgtagttcagtcccaattgtgatgctgcccaaaatagaagaagaaacccagcatctgaagcaaacacacttagaatatttcagcctttggtgtctaatgttaaccctggagtcacaatcgaaggataataaaaagaatcaccaaaatatctggctaatgcctgcttcggaaatggagaagagtggcagttgcattggaaacctgattagaatggaacatgtaaagatagtttgtgatgggcaatatttacataatttccaatgtaaacatggtgccatacctgtcacaaatctaatggcaggtgacagagttattgtaagtggagaagaaaggtcactgtttgctttgtctagaggatatgtgaaggagattaacatgacaacagtaacttgtttattagacagaaacttgtcggtccttccagaatcaactttgttcagattagaccaagaagaaaaaaattgtgatatagataccccattaggaaatctttccaaattgatggaaaacacgtttgtcagcaaaaaacttcgagatttaattattgactttcgtgaacctcagtttatatcctaccttagttctgttcttccacatgatgcaaaggatacagttgcctgcattctaaagggtttgaataagcctcagaggcaagcgatgaaaaaggtacttctttcaaaagactacacactcatcgtgggtatgcctgggacaggaaaaacaactacgatatgtactctcgttccagcgccagaacaagttgaaaaaggtggtgtgagcaatgtaacagaagccaaactcatagttttcctaacctccatttttgttaaggctggatgcagtccctctgatattggtattattgcaccgtacaggcagcaattaaagatcatcaatgatttattggcacgttctattgggatggtcgaagttaatacagtagacaaataccaaggaagggacaaaagtattgtcctagtatcttttgttagaagtaataaggatggaactgttggtgaactcttgaaagattggcgacgtcttaatgttgctataaccagagccaaacataaactgattcttctggggtgtgtgccctcactaaattgctatcctcctttggagaagctgcttaatcatttaaactcagaaaaattaatatcattgatcttccatcaagagaacatgaaagtctttgccacatattgggtgactttcaaagagaataaaacactatttcccttgccttttcatactagggcagtatctcctctagctagtgcccatacagaaaattctatcaccatacaaaatttaatgcagtatttatgttttaaagcacaggtgtaccgaaaactgtgaaaagtctgaatttatgggttctatgcatgcatttttgcctaacctagagaaagagtttgataaatttttaccagctttgaagatggattaacttttgactttgagctttaaacttttaagtcagacatttcaggactaatttgattttgtagatatcattgtaagaactttatttgaaagactgaataaagggatttgatttgttttcatcatttaagcacagtcttgtgatgatgagaacataagtgtgattcttttctgtattttgaggtccctaatccaaagcccattttgctaggattttttctgctatcagatgtgttttcactctaaacctagtcttttatgacatgaattgattacttcctgttaattttctatcctcccttactatcctccttttttgttttcagtattcagtatttcagtattctagagtagattttgatataaaagaaaataattcttacatcatcttttgcaacaaattttgttttctgaattgataataaatttaaaaagttgattcctattttcacatatgttcatatgcccctatgtttgggggtatcactcagttttcccttttttgtgtaaagatgttttgtaaaacaaaattgtctcaaagtgattatattatatatataaaaagtaacagattttaacaaaggttaaaagattcttggggtaacagattcttctggggcttggaaatcttccatttctcttgagggttttttttaatgagtgttaaatatgttaaaatttttatttctacctcatgtgtttttttaaattattacttgaagttttttatttaataaattttttctactaatgga

SEQ ID NO: 127582 - DNA, 2609 bp, Homo sapiens
  Payload ID: 4968
  Gene Symbol: DDI1
  Gene Name: DNA-damage inducible 1 homolog 1
  Uniprot ID: Q8WTU0
  ENST ID: ENST00000302259
  CDS Start-End: 244-1434
agaaatggactttggaacacaacgtgctacctcaaggctccacctggccacacagcaggcactgaggctgggagacagcccccagacagatgagtgtccgcgcctctctgagaggtgaatgagcccggacggtccctacctaccaagtcctgaggagcagcggcaccaacgacgcaggcccgccccagcccgccagtgagccgcccatgccctctgctagcccggcccgcccgggcccccgccatgctgatcaccgtgtactgcgtgcggagggacctctccgaggtcaccttctctctccaggtcagccccgactttgagctccgaaacttcaaggtcctctgcgaagcggagtccagagtccccgtcgaagagatccagatcatccacatggagcgactcctcatcgaggaccactgttccctgggctcctacggcctcaaagatggcgatatcgtggttttactgcagaaggacaatgtgggacctcgggctccagggcgtgccccgaaccagcctcgtgtagacttcagtggcattgcggtgcctgggacgtccagctcccgtccacagcaccctggacagcagcagcagcgcacacccgctgcccagcggtcacagggcttggcgtcaggagagaaggtggccggcctgcaaggtctgggcagccccgccctgatccgcagcatgctgctctccaacccccacgatctgtccctgctcaaggaacgcaaccctcccttggcggaagccctgctcagcggaagccttgagaccttttctcaggtgctgatggagcagcaaagggaaaaggccttgagagagcaagagaggcttcgtctctacacagccgacccactggatcgggaagctcaggccaaaatagaagaggaaatccggcagcaaaacattgaagaaaacatgaatatagcgatagaagaggcccccgagagttttggacaagtgacgatgctctacattaactgcaaagtgaatgggcatcctttgaaggcttttgttgactcgggcgcccagatgaccattatgagccaggcttgtgccgagcgatgtaacatcatgaggctggtggaccgacggtgggctggggttgctaaaggagtgggcacacagagaattattggccgtgttcatctagctcagattcaaattgaaggtgatttcttacagtgctctttctccatacttgaggatcaacccatggatatgcttctaggcctagatatgctccggagacatcaatgttccatcgatttgaagaaaaatgtgctggtcatcggcaccactggcacgcagacttattttcttcctgagggagagttgcccttatgctctaggatggtaagtgggcaagatgagtcttcggacaaggaaattacacattcagtcatggattcaggacgaaaagagcattaaagcacgttataaatatgttaccaccttgagggagcctcaggtccccggcaattataagttaagagcttactggcaatgtaatcattaaaaaacatcagtaacaactaaacctggccttgggactacgttctcagatgggtaactaacgtcaatcctgattccttggtcttggtccctcttccatttcccttgtccagagatcactgaaaggcatcctgggaaggctctggaggctccagctgatttccagataatccatgaaaaagaaaaccagcttcttcctttagagacactatcctatcagattacaggtggcttatccaaatcattgctattttgcagaattccctggaaaaatgctatggctgcagaccttacaaggcatccacataaaactatttcacatcagcactaataattctttctactgagagaaatatgcccattttcacaggttttgttttctttgggaagggtattagaaatggtaggtcagttacactatgatgttaactaatacttatacatgtctgtttggggcagcataaagaccaatttcctcatatttacaccttcccttcccctggatcccctgcagtcaccctgcaatccacagctaaagactatttttgccatatttgagaaagtggatttatctccaaggatgctacattaattttctatttctcctgcattcaaagaaactctggctataaaacaaaggcaataaattagattttttaaaaaagaaattatggtacttcttgggagtcaagttgtacagtggtgggaatgagaggtggggacaggcagtggtccaggttctctaatagtcattgcaactagatcatctctctctctttttcaaagtaaaaatctgctttatacattaagctgctgctacatcagtattgtttgaacaaaggttttcactgttaaaataacatttgaaaacttttgaatgagaagatctctaaggcctcattcagaattatccattctgacaatgttagtgtttattacaactgacagtgggtaatggaagatcctagacttaattacaacccatggctaaagcacctgagagaaaagtttcagcttcctgaggccatcagatgcaggggaaatgtttcaggacaataatttatcaaaactagtattaaaacagcggattc

SEQ ID NO: 127583 - DNA, 10625 bp, Homo sapiens
  Payload ID: 4969
  Gene Symbol: DDI2
  Gene Name: DNA-damage inducible 1 homolog 2
  Uniprot ID: Q5TDH0
  ENST ID: ENST00000480945
  CDS Start-End: 172-1371
gagggcgggagggagtgactcactgagcgtgtgtgagggagggagcgagcgagcgaacgagcagccggcgccgtcctcccgcagcaccagccaggccacgccgccgcctcttcccctgcgccccgcgcccaggccgggccgagccgagccgagccgggtcgggcccgggccatgctgctcaccgtgtactgtgtgcggagggacctctccgaggtgaccttttccctccaggtcgacgccgacttcgagctgcacaacttccgcgcgctgtgcgagctcgagtctggcatccccgcagccgagagccagatcgtctatgcggaaagacctctcacagacaaccacagatcattggcttcttatggcttgaaagatggggacgttgtgattttacgacagaaggagaatgcagaccctcgacctccagtgcagttcccaaacttaccccgaatagatttcagtagtatagctgtgcctggcacatcaagtccccggcagcgccagccaccaggaacacagcagtcccactcatctcctggagaaataacttcatctcctcagggcttggacaatccagccttgctccgagatatgttgctggccaacccgcatgagctgtccttgctgaaggaacgcaatccacccctggcagaagctctgctcagtggagaccttgagaaattttctagagtcctggtggagcagcagcaggaccgagcccggagagagcaagaaaggattcgtctgttttctgctgatccctttgaccttgaagctcaggcaaagatagaagaagatataaggcaacagaacattgaggaaaacatgacaatagctatggaagaggctccggaaagttttggccaagtagtgatgctttatattaactgcaaagtgaatggacatcctgtgaaagcctttgttgactcaggtgcccagatgactatcatgagccaagcttgtgcagaaaggtgtaacataatgagactggtggaccgtcggtgggcagggattgccaaaggagtgggcacccagaagattattggaagggtacatctagctcaggttcagattgaaggagattttttgccatgttccttctctatacttgaggaacagcccatggacatgcttctgggactggacatgcttaaacggcaccagtgttccatcgacctgaagaaaaatgtactcgtgatcggcaccacaggctcccagaccacctttcttcctgagggagagctaccagagtgtgcccggttggcatatggggctggaagagaggatgtacggccagaggagattgcagaccaagaattagcagaagcccttcaaaaatcagcagaggatgcagagcgtcagaagccatgatgcatgtagtgtgtgtgtactgcagctggagtgggccccagaccagagaaaagtggtaaagaatctacctcactgggaatgtcatcattaccaacttcagatgggtttaaccatcccgcccgttcttcaggacagagtcctgatgttggtaatcctatgagtcttgctcgctctgtctctgcttcagtctgccctatcaagcccagtgactcagatcgcattgaacctaaagctgtgaaggctttgaaggcttcagctgaattccagctaaactctgaaaagaaagaacatctttctttacaagatctttctgatcatgcttcctcagcagaccatgctccaacagaccagagtccagctatgcctatgcagaattcatccgaagaaataactgttgcaggtaatctggagaaatctgctgaaagaagcacccagggcctcaaatttcatctccatacaagacaggaagctagtttatctgtcacatctactaggatgcatgaaccacagatgtttctaggtgaaaaggattggcatccagaaaatcagaacctgagtcaagtgagtgaccctcagcagcacgaagaaccagggaatgaacagtatgaggttgcacaacaaaaagcttcacatgaccaagaatatctttgtaacataggggaccttgagcttcctgaagaaaggcaacagaatcaacacaaaattgttgatttggaagctacgatgaaaggaaatgggctcccacagaatgtggatcctccaagtgcgaagaaaagtattccatcttcagaatgcagtggctgctcaaattcagaaacatttatggaaatcgatacagctcaacagtccctagttactttgcttaattcaacaggcaggcagaatgccaatgtcaagaacattggtgcattggatctcactttagataatcccttgatggaagtagaaacatcaaaatgtaacccttcatctgaaattttgaatgattccatttccactcaggatttacagcccccagaaactaatgttgaaatacctggaacaaataaagaatatggccattactcctctccaagtctctgtggcagttgtcagccttctgtggagtcagcagaagaatcttgcccgtctataacggcagccttgaaagaacttcatgaacttttggttgttagcagtaaaccagcttcagaaaatacatctgaagaagtaatctgtcaatcagaaaccatagctgagggccaaaccagtattaaagacctttctgaaagatggacccaaaatgagcatcttacccagaatgaacagtgtccacaagtctcctttcatcaggccatatctgtatcagtggagacagaaaaattaacaggtacttcatctgacactggaagagaagctgtagaaaatgtaaacttcaggagtctaggtgatggcctgtcaaccgataaggaaggtgtccccaaatctagggaatccataaataagaaccgttctgtcactgtaacctcagctaaaacatccaatcagttacactgcaccttaggtgtagaaatttcacccaaacttttagcaggtgaggaggatgcactcaatcagacttctgagcaaactaagtctttgtcatccaatttcatattggttaaagacttaggtcagggcatacagaattcagtaacagacaggcctgaaaccagagaaaatgtctgtcctgatgcttcgaggccattacttgaatatgaaccacctaccagccatccatcatcaagtcctgccattcttccaccattgatttttcctgccacagatattgaccgcattctccgtgctggctttactttgcaggaagctcttggagctttgcatcgagttggtgggaatgcagaccttgcacttcttgttttgctcgcaaaaaacatcgtagttcctacatgactgtgggaaagtgggctagaccgttctccattccctttaaacaaaagaaagctctctctatatacacgcacacatacacactcaccacatatacagtatatatagaaacctgcaagcagaatgttgagccagattttttttaaagatttttttcggccaaagtaatttatgatcttttgtctgatgaatttgtctatcctacttgttaaaatttaggcctttttaaatgtattggcagtatgtgcatacagaagctttttattctcattaagatgtatcctggaataaaatggatggttttgtgtgtagcatactgttttagaatgagagtaaatgctttgaaaagcagaagccatgagaaatcccactacccatccagctaaaaacagatgaactctccacactgtgactgtgtgtctgtgctgatggcaaggtatggtttgctggctcagttgtcaatttagaaacttttgaccacataatttggtgtttggaattctacccagtgctctgtgtatcatgattcattaattataacaggaaattggagaataattgaatatcttatcgtagagtggtatgtttttatttgtgtgcttaggatttgacattttaatagggcgagcaggagggtttaaatcttgggctactttgtgcatcacaggctgctgcatggattgccatgaatccttattacattggatgggatattgtgggggagttacaatgcaagtgaaacgtggtgctacccagattcttaaaagaacagaacaaccataattccatttgcagatgtcaagaactgtgagggaaaaataatggcctaaacactggaatttgctagagtttgggtttgctagcatctcactgataacacctcaacccttaatgactaatggtggaattaagttcaggaatggattcattgccagcagcttatttcctttctagactcttctgccaggaagttcttcaaacgctcagtgtgagctgtgatctgagtgaaatactaagtgtgataaccttgtcactggttaatcttggtgcttggaacggtcagtctatttggagagtgtcctttgtggcagtggaaatagtaattacagtttctgacttaagtggccttggtagagttttccatccttttctttcctcaggagtttcttttttaagcaaaattcatcttatttgtgtttaccatgtcaagttagagtggggcataatatatagatgtatttattgtggcctttttttatataaggactagcccttggaaatcattgtcctgtgggccccactgtgcaataatcctactggataggttttagataattctttcctggcaaactgctcttttgggtacctagcaggaatctgaagtcttggttttattgaaaagaattttgagattcataatttctgattctagattatagtttgtaacatgtttgaaacagaagcttcgaaagagtgatttctcaacttagtgttaaatgattttgtctgaagtctgactctttgtaagcttgtttgtttcatcaaattttaagtcattgagcacaatcaaaatggaggctcatatctcaggagtttttgaaattttaatttaggggcacttagagacatttttttctaccccatccaacttctttctttccttttgctatgatgtttgtatgtatgttataagactttagtgatgggatggcgtgtcacgtagattcatcatgatcctttatgtagttaggaaatggttgacagaaggaattgtagtttactgcttttcagagggcgtgaagaacaacaggtcagccaggttgtctttaagatgttcttttagacagctgcacattgtagaccctttcacctgccctacaccaaagatgtacgatgcactaggaaactgctcataggatttctgtcagctgacttaaagctgtgattgtaattaaatagttggtgctatgattgatgcaaaatctagtagcaatgcaatgggaccctgtatttgctttatgggtggtggtttgggaatgtattctaagcttataaatctttggaaccacggggtgggaagggtgggggaacttactgatgacaatagactccctcctaaagggccttccatgtaagcagaacgaaccttggcacacaattcagtgtggatatttgggaaacagttccaagtggaatatataatatcagtcgggaaaagatttcattaggatagctttttgtgtatgtatatgtatatttatttttaggaatagatctatagttgtacatgaattcctgttaggaatactctgaatgagcttaacccacttgccaaatatccttgtcccttccatcattttatttttgagatggggtcttgcagtgttgcccaggctggactcaaactctggggcttaatcatccttctgagtagctgggactacataaaggccaaagtataattgcttttgatttttaaaatcttcttgcccatcatttttataaaaataaagctgtttgtccaacacggtgaaacctcatctctactaaaaatacaaaaaattagctgggcatggtggcacacgcctgtaatcccagctacttgggagactgaggcaggagaattgcttgaacctgggagatgggggttgcagtgagcctagatcacgccactgcactccagtgtgggcggcagagtgagactctgtctcacccaaaaaaaaaaaaaaaaagctattgacactgttaatattttggatgacttaaatttagcagctctagaatgcaaagggtatattaaggagcattacaatagtgaaccttcatcgtcagcttttattcaattaagagctccagaaatgcagaaattatgggttaacttctaagaataccatcaaatccctgtgaattctggttgccaacagtaataaccagtaatgggcacctttaccggacagctcctttaccataaccagtagtgggcagttctgcggtcagcacttaactacaagggcggtctctgtttcttcaccagagagagaagattttcctgtgtaatttgtgccatttccctgaagttggttcttgagcggaaagatgtgcttggtaaccagacagcagctttacataggttatagattttgctcattgatgctgttaagaattatttccactcatacctgttcagggctccagacagccaatagccttcatcccacagtttgggcttcagctattaacacataaagataaccagttgcagctaggctcggtggctcacacctgtaatcccagcactttgggaggccaaggcgggtggatcacctgagggcaggagtttgagacaggcctggccaacatggtgaaactccatctctactaaaaatacaaaaattagccgggtgtggtggcccatgcctgtaattccagctactcgggaggctgaggcaggagaatcacttaaacctgggaggcggaggttgtggtgagcagagatcacgccattgcactccagcctgggcaacaagagcaaaactctgtctcaaaaaaaaaaaaaaaaaaggtaaccagttgcttggcaaaggaagctggagagatggcgagtgcatgtgttaaaactcttctgccttgcagcccacatcttctagagctccctgtcttcatatgtactaaagggagacacaaccctatgtgttttttcccaaagcatgtctctagcaagagggtacatagaaatggaacatgaggctttttgtcactgattttatgataaccagttaatgtggaatctgctggttgtcttactacagctttctatctccggtgaaagccataaaaatttaggttaacttttaagctcatgtctatatatatgtgtgtaagctagcatatacatatggtgattgacaagtatagttaattttatatggatttaaaagcaagcaatttttatatctacagacgtactcttcacttatggtggcttttatcccgccacatatataaatatatatatatatagcaaacagccttgcaaatcatcggccagaaaagctgcagggcgttgcaatggccttttcctacctgtttgccacctgtggtgagggtgagcaggatgattgaactgctgcatatttcaaacctgttatcactggcagtgtgtcccaagagaagctgaccagattatgcattctactgttctctagcacaagtactcaccaaaaagccaaatttcccctttggagttggtgacttagtgtagtctgtggctgacctagaaagacacagagttatcaagagtttcccttcctagaagatgaatgttaccttttgtgttaggaggtagagaaaataaaaatagcttttttttccctagaattgctaattactcttaacaacaaattaaattcaaagcctgtccttgagaactggaaatgtaaaatcatggttcaagttttataccttagtgattcctcagtaggtgttactaggagttcactgaatgaacttaggagtgaaccttcgatgtgcttgattttcttttgtgccttagtttctctgaatagcagaggcatcaaattttggtggggaatgagaggagtattaggggaaagtttgaaaatagctctcctggagatggagggcacacagagtggtcctcaggctcaccttgactgagttgattcacagttatcctgcatcagaccattagatttctttagtgctatgattataatagggatttttgaatcaccaaaaacagtttttagatgtttatgttctttgttttactatcaatgttgtgctggttaagggagagaaaagttcaagaagatcttacatatttgaaaggaaattggtactcttgaaggctatgcaacatgagtctttgaacaagaattccttgctactttgattcattcatcaaatactgagtgcctgtgtgccaggcacaggtgaactctggggattcaggggtaactaaaacagattggaaccctgcccttgtgaagctttcagtctagaagggagacgtgaaacaaattttagcttcaaaagcaacatctatttttgcctgttagcatgcatttattttaaaagtcatattagagttacctggttccacttcagagcagactgggaaaatcaggcttacaatggaatcagatgctgtgggcctaaaacagctctttaaaaatctatttttttaggccaggtgcgttggctcacacctgtaatcccagcactttgggaggccaaggtgggtggatatgaggtcaggaggtcgagaccagcctggccaatatgatgaaaccttacctctactaaaaataaaaaattagccgggcatggtggcacatgcctgtagtcccagctactcgggaaactgaggcagaagaatcgcttgaacccgggaggcggaggttgcagtgagccgggatcacgtcactgtactccagcctgggcaagagtgagacaccgtctcaaaaaaaaaaaaaatttttttttaaatggaatcagagaaaccaacaaaatatgtaacatgtataaatgcctgaggagatcagttattgagaaatccatttacaatgctggaggagaggggatggccaggaaagaagtgcaacaaataaatggaagatgaccctaaaaatgcaccagtgacagtcagtcaatccatcagaccacctcacatgcagggtagaaacatggagtgtgcggcagcatcctcctcacatccctttgtgagcacggctgctccggaatactgaccatctgggctagcacgacttagcagagggttctgcaggatgtgctattttaaagcagctgggtgcaacttgtgaaaacgggaatctagagcagaacatgtaatcagcgatggctgggattggtggacaggattgacaggagtatttgaggctctaccaggcctgtctacaggacagcttcatcaaagggacattttttaacctgttattttaaatgccacatatatgttgtaatgctgaagcatacaggtagaatttctggatcgtaactactagtgacttctgaggtttacagttagaaaatgttctcaaaggtttatcagttatgtattgatgattggtaatctagaccctctggaggctgtagaatgtgaaaagatacagctgagctgacaagttttagggcactatcttctggaatgaaatcggccaagaaaatggttcaagggcatgggggttagagaatgtttcttttacctaaaaatgttaagccaactatggaagattggggtcgtgggggcatgaaatacaaaattatgataatttatacagaactaggtttctttatgttctgcaagaaggtttttattagctaatttggggaggggggcatgctgcagtattttttttcctgggaacatgcatttctgatgggaagttattttgtttacaagagttggttttacacacaaccctgaatgaatgtgtctatggcctaaaaatggtagacctgtatttccttcccgaggcaggctgattcgtttcctgattccttctgtctgagattacctgatgctgaccagacttatttttcctttcctgaatcttcacagctgagtttatggcacccatccaagaccttcccatttgaatgactagatttctattctatccccgatcatccttttgaaatagttctagtgataaactcagagaaattcaatatattgattgaattttattttttcgctttgtatctacaacagaaattgatttgttcatttttatttcaaatctcttcatggcaagttgggctaatggactttgcactcaagaaaggtttgtttaccagttttgtagccatgtttggcaaatcttagcaactagaaaccccgtcctttcttttccttctttatatgttcttgcagttactcttgtattgcaagattttctgactttaagctttgagactactgcatcttaaaagaagaactaggctgactggcaaaaagtcttgccagtggccctgtcactcccatgatgctttggttttgagagttgggaaaactctgagaacttaagggaaccaaactcaggaatcccaaaattggtggcattgtgccattcgtttaggggctgaacataggacctgtctgaaactgagtgagctagatgcatttgggtttgaatttttgtcacatactgaaatgtaagtcagccctaaataatcaaaacactttattttatttttctttttttaaataggaactttctgaagaaaaagtggtgtgtaaaacatttgatatttaagacaataaagtttttatcataaga

SEQ ID NO: 127584 - DNA, 497 bp, Homo sapiens
  Payload ID: 4969
  Gene Symbol: DDI2
  Gene Name: DNA-damage inducible 1 homolog 2
  ENST ID: ENST00000483899
  CDS Start-End: 1-310
agaaataacttcatctcctcagggcttggacaatccagccttgctccgagatatgttgctggccaacccgcatgagctgtccttgctgaaggaacgcaatccacccctggcagaagctctgctcagtggagaccttgagaaattttctagagtcctggtggagcagcagcaggaccgagcccggagagagcaagaaaggattcgtctgttttctgctgatccctttgaccttgaagctcaggcaaagatagaagaagatataaggtgcccagatgactatcatgagccaagcttgtgcagaaaggtgtaacataatgagactggtggaccgtcggtgggcagggattgccaaaggagtgggcacccagaagattattggaagggtacatctagctcaggttcagattgaaggagattttttgccatgttccttctctatacttgaggaacagcccatggacatgcttctgggactggacatgcttaaacggcaccag

SEQ ID NO: 127585 - DNA, 2076 bp, Homo sapiens
  Payload ID: 4969
  Gene Symbol: DDI2
  Gene Name: DNA-damage inducible 1 homolog 2
  ENST ID: ENST00000320153
  CDS Start-End: 1-300
cagcagtcccactcatctcctggagaaataacttcatctcctcagggcttggacaatccagccttgctccgagatatgttgctggccaacccgcatgagctgtccttgctgaaggaacgcaatccacccctggcagaagctctgctcagtggagaccttgagaaattttctagagtcctggtggagcagcagcaggaccgagcccggagagagcaagaaaggattcgtctgttttctgctgatccctttgaccttgaagctcaggcaaagatagaagaagatataaggaggactccctgactagcagacagagcatcataacacagctttagataaatgacccccggactgagcagaagccaccatctggtgcccagatgactatcatgagccaagcttgtgcagaaaggtgtaacataatgagactggtggaccgtcggtgggcagggattgccaaaggagtgggcacccagaagattattggaagggtacatctagctcaggttcagattgaaggagattttttgccatgttccttctctatacttgaggaacagcccatggacatgcttctgggactggacatgcttaaacggcaccagtgttccatcgacctgaagaaaaatgtactcgtgatcggcaccacaggctcccagaccacctttcttcctgagggagagctaccagagtgtgcccggttggcatatggggctggaagagaggatgtacggccagaggagattgcagaccaagaattagcagaagcccttcaaaaatcagcagaggatgcagagcgtcagaagccatgatgcatgtagtgtgtgtgtactgcagctggagtgggccccagaccagagaaaagtggtaaagaatctacctcactgggaatgtcatcattaccaacttcagatgggtttaaccatcccgcccgttcttcaggacagagtcctgatgttggtaatcctatgagtcttgctcgctctgtctctgcttcagtctgccctatcaagcccagtgactcagatcgcattgaacctaaagctgtgaaggctttgaaggcttcagctgaattccagctaaactctgaaaagaaagaacatctttctttacaagatctttctgatcatgcttcctcagcagaccatgctccaacagaccagagtccagctatgcctatgcagaattcatccgaagaaataactgttgcaggtaatctggagaaatctgctgaaagaagcacccagggcctcaaatttcatctccatacaagacaggaagctagtttatctgtcacatctactaggatgcatgaaccacagatgtttctaggtgaaaaggattggcatccagaaaatcagaacctgagtcaagtgagtgaccctcagcagcacgaagaaccagggaatgaacagtatgaggttgcacaacaaaaagcttcacatgaccaagaatatctttgtaacataggggaccttgagcttcctgaagaaaggcaacagaatcaacacaaaattgttgatttggaagctacgatgaaaggaaatgggctcccacagaatgtggatcctccaagtgcgaagaaaagtattccatcttcagaatgcagtggctgctcaaattcagaaacatttatggaaatcgatacagctcaacagtccctagttactttgcttaattcaacaggcaggcagaatgccaatgtcaagaacattggtgcattggatctcactttagataatcccttgatggaagtagaaacatcaaaatgtaacccttcatctgaaattttgaatgattccatttccactcaggatttacagcccccagaaactaatgttgaaatacctggaacaaataaagaatatggccattactcctctccaagtctctgtggcagttgtcagccttctgtggagtcagcagaagaatcttgcccgtctataacggcagccttgaaagaacttcatgaacttttggttgttagcagtaaaccagcttcagaaaatacatctgaagaagtaatctgtcaatcagaaaccatagctgagggccaaaccagtattaaagacctttctg

SEQ ID NO: 127586 - DNA, 3519 bp, Homo sapiens
  Payload ID: 4970
  Gene Symbol: DRAM1
  Gene Name: DNA-damage regulated autophagy modulator 1
  Uniprot ID: Q8N682
  ENST ID: ENST00000258534
  CDS Start-End: 440-1156
gggaaggccagagcgggcgtccccgccagtgaccccacgccgcccgtccgcgcccaacccggcctccgccgagtgtccaaaccaaaagcgaaaggaacccgaccccgcgtcccctccggcggctccgtagtcgcgtccgcttggagctcgccgggcgcctccgaccctgccgggccgctttgtgacttcactcgtttcgcaacaagcccgggcagcccgcgccccacccactctggcccggcagcctcgccgcccgcagcctcgctccgctcctcgcgcttcccctccctccggggctgggcctgccccggccgtcgcggagcctcccctcccaccgtccgtgagtgtacgcgcccggccgccgcctccaggcagcccggagcaacccggcgcccggccccgctgggcgcagcactccgtcggcggcggcggcggcgcgatgctgtgcttcctgaggggaatggctttcgtccccttcctcttggtgacctggtcgtcagccgccttcattatctcctacgtggtcgccgtgctctccgggcacgtcaaccccttcctcccgtatatcagtgatacgggaacaacacctccagagagtggtatttttggatttatgataaacttctctgcatttcttggtgcagccacgatgtatacaagatacaaaatagtacagaagcaaaatcaaacctgctatttcagcactcctgtttttaacttggtgtctttagtgcttggattggtgggatgtttcggaatgggcattgtcgccaattttcaggagttagctgtgccagtggttcatgacgggggcgctcttttggcctttgtctgtggtgtcgtgtacacgctcctacagtccatcatctcttacaaatcatgtccccagtggaacagtctctcgacatgccacatacggatggtcatctctgccgtttcttgcgcagctgtcatccccatgattgtctgtgcttcactaatttccataaccaagctggagtggaatccaagagaaaaggattatgtatatcacgtagtgagtgcgatctgtgaatggacagtggcctttggttttattttctacttcctaactttcatccaagatttccagagtgtcaccctaaggatatccacagaaatcaatggtgatatttgaagaaagaagaattcagtctcactcagtgaatgtcgcaggccatttctaaaagtgctacagaggacagacagggttttgaggccaccctgattattgggatgcatctgcagcacatccaggacttgaatttcattacgagttcctaatagttgtatttctaaagatgtgtttcctagagaatgtacagccttatgacactgtagtgatgtttttataattttctaagtagatttttttatattaacaaattcatatacagaaaaaataaggtgttacaaaaaatggagagctcttatttttgtacagattctgtcgtttttgttttatttgtgtgagatttatggaaatacactaaatgagtaattcaggttcagtacatttattacaaagtgaaatcaggggatattcatttgtaaattttattcttagtgaatgaactgtataattttttttatcaggagagcacttataaaattcaatttataaagatcatatacccaaatcataaagatttagttgatacattaacactaagatactctgatttttagccgaactaaacaaagtgcttctactgagaggcctttataccaccatgtacagtaactctaagtgaatacggaagaccttggttttgaaattctgccaccttgtttctccctgctcatgaggtcgcaccttttgctcttgctgctaattgcccattcgtagtgggtgtaatgccaggtggaatggtttcaacaagtcaggtgaaaaccatcctttattgttgctggcacaacttgatatatagtctgactcagaactgaagctcacatctcaaattcatttcatgccagtaaatgtggcaaagagaagaaaggcccaagagcgagacaagaagaatggagaagggggcagccaagaagaacttctgggttcagggtactgtttatttgctccttctcttcatgcctgtggctggatgtcccacaacactataagaaatataagtcaagccctttgtgttaagcaagaactacagactccatcttttcacccaaatcatgaatgaccaataaaaagcaagttattccagaggaagaagcagcccttgaaatgttaaggcttaggcttgaaaggtgaagagcaggaattctctctttcaaatcctagagcataaacccatgtgtggccaagtgagatcagccctcaagggcacatgccaagggcagagcagcccatgtagacagcttcggagggcatgggggtgtagggagttcggggtagctcctcattaactatttgttgggtgagtaaaggggtgaggctcagtggcaggtacctctgcaatgacaagctgcctcccctctatgtgtttagcatatgttattagaacatgtccgacacccctaccgctgccatttgggccctttaataaagccaagtagagaaatctggcaataaaaggcaaatgtaagcatgctttctttaagacgcatcataaatggttttctttaagtgaatggaagagtttgacagagatacacctttgtaagaaaacattaagaatgctggctggctgtggtggctcacacctgtattcccagcactttgggaggcctaggcaggaggattgcttgagcctgggacttcgagaccagactgggaaacatggcaaaatcccatctctacaacaaaaatacaaaaattagccaagtgcggtggtgtgcctgtagtcctagttacttgggaggctgaggtgggagaatcacctgagcccaggaggtggaggctgcagtgagccatgccaatgcactccagtctgggcaacagagtgagaccctgtctcaaaaataaataaataaataaatgaataaagagaatgctaatcatttctgggttcactgcgactcactgtagtgctggggatcccccttgtaacactggaactgaaagacagtgatgaaagctatgtcaagcattcattattctgaagaggaggagaaatgccacatacctttcccatgggacctgtggtggaatgaatccatacttctgcctcacttcgagcagacttttgttctcggcgctcctcacgatggagtttcatgcttcattttcacatctctctgcacaattagattgggagctccttgagggcagagtacgtgccttaatctttatctttgtaatgccacaatgaacagagtgcctcctggtacactgtaggagcttaagaaatactcactgaatgcatgaatgaatgaatgaacaaatgaaggaatgactaaggatgtttgtagtgctataatatagaatgggatttactctgctttaccagttagtttcataataaacaaatagtctgtatcgcctggtaa

SEQ ID NO: 127587 - DNA, 1048 bp, Homo sapiens
  Payload ID: 4970
  Gene Symbol: DRAM1
  Gene Name: DNA-damage regulated autophagy modulator 1
  Uniprot ID: Q8N682
  ENST ID: ENST00000544152
  CDS Start-End: 108-494
caccgtccgtgagtgtacgcgcccggccgccgcctccaggcagcccggagcaacccggcgcccggccccgctgggcgcagcactccgtcggcggcggcggcggcgcgatgctgtgcttcctgaggggaatggctttcgtccccttcctcttggtgacctggtcgtcagccgccttcattatctcctacgtggtcgccgtgctctccgggcacgtcaaccccttcctcccgtatatcagtgatacgggaacaacacctccagagagtggtatttttggatttatgataaacttctctgcatttcttggtgcagccacgatgtatacaagatacaaaatagtacagaagcaaaatcaaacctgctatttcagcactcctgtttttaacttggtgtctttagtgcttggattggtgggatgtttcggaatgggcattgtcgccaattttcagagtgtcaccctaaggatatccacagaaatcaatggtgatatttgaagaaagaagaattcagtctcactcagtgaatgtcgcaggccatttctaaaagtgctacagaggacagacagggttttgaggccaccctgattattgggatgcatctgcagcacatccaggacttgaatttcattacgagttcctaatagttgtatttctaaagatgtgtttcctagagaatgtacagccttatgacactgtagtgatgtttttataattttctaagtagatttttttatattaacaaattcatatacagaaaaaataaggtgttacaaaaaatggagagctcttatttttgtacagattctgtcgtttttgttttatttgtgtgagatttatggaaatacactaaatgagtaattcaggttcagtacatttattacaaagtgaaatcaggggatattcatttgtaaattttattcttagtgaatgaactgtataattttttttatcaggagagcacttataaaattcaatttataaagatcatatacccaaatcataaagatttagttgatacattaacactaagatactctgatttttagccg

SEQ ID NO: 127588 - DNA, 611 bp, Homo sapiens
  Payload ID: 4970
  Gene Symbol: DRAM1
  Gene Name: DNA-damage regulated autophagy modulator 1
  ENST ID: ENST00000549365
  CDS Start-End: 1-140
gcttcctgaggggaatggctttcgtccccttcctcttggtgacctggtcgtcagccgccttcattatctcctacgtggtcgccgtgctctccgggcacgtcaaccccttcctcccgtatatcagttattttttgagatgaagcctcactctgtcggccaggctggagtgcagtggcacgatcttggctcactgtaacctctgcctcctgggttcaagcgattctcctgcctcagccacccgagtagctgggattacagtgatacgggaacaacacctccagagagtggtatttttggatttatgataaacttctctgcatttcttggtgcagccacgatgtatacaagatacaaaatagtacagaagcaaaatcaaacctgctatttcagcactcctgtttttaacttggtgtctttagtgcttggattggtgggatgtttcggaatgggcattgtcgccaattttcaggagttagctgtgccagtggttcatgacgggggcgctcttttggcctttgtctgtggtgtcgtgtacacgctcctacagtccatcatctcttacaaatcatgtccccagtggaacagtctctcgacatgccacatacggatgg

SEQ ID NO: 127589 - DNA, 427 bp, Homo sapiens
  Payload ID: 4970
  Gene Symbol: DRAM1
  Gene Name: DNA-damage regulated autophagy modulator 1
  ENST ID: ENST00000549066
  CDS Start-End: 1-160
ccacatacggatggtcatctctgccgtttcttgcgcagctgtcatccccatgattgtctgtgcttcactaatttccataaccaagctggagtggaatccaagagaaaaggtaatacaggagttgatggcaacgatggttactcattatgaaccacactgaaacgaccttcaattcaatttccatctgctaataaatatagtcaagtgctgcataatgttttggtcaacatcccctaagattataaaaccatatttgactgcaccttttctacatttagatacacaaataccactgtgttacaactgcctacagtattcagtacagtgacatgctgtgcaggtttgtagcctagaagcaataggtttgtgtaagtacacttgttatgaaatccacaatgtttgtacaataaaaccgcctaatgacgca

SEQ ID NO: 127590 - DNA, 920 bp, Homo sapiens
  Payload ID: 4970
  Gene Symbol: DRAM1
  Gene Name: DNA-damage regulated autophagy modulator 1
  ENST ID: ENST00000551403
  CDS Start-End: 100-444
gtgagtgtacgcgcccggccgccgcctccaggcagcccggagcaacccggcgcccggccccgctgggcgcagcactccgtcggcggcggcggcggcgcgatgctgtgcttcctgaggggaatggctttcgtccccttcctcttggtgacctggtcgtcagccgccttcattatctcctacgtggtcgccgtgctctccgggcacgtcaaccccttcctcccgtatatcagtgatacgggaacaacacctccagagagtggtatttttggatttatgataaacttctctgcatttcttggtgcagccacgatgtatacaagatacaaaatagtacagaagcaaaatcaaacctgctatttcagcactcctgtttttaacttggtgtctttagtgcttggattggtgggatgtttcggaatgggcattgtcgccaattttcagtgattgtctgtgcttcactaatttccataaccaagctggagtggaatccaagagaaaaggattatgtatatcacgtagtgagtgcgatctgtgaatggacagtggcctttggttttattttctacttcctaactttcatccaagatttccagagtgtcaccctaaggatatccacagaaatcaatggtgatatttgaagaaagaagaattcagtctcactcagtgaatgtcgcaggccatttctaaaagtgctacagaggacagacagggttttgaggccaccctgattattgggatgcatctgcagcacatccaggacttgaatttcattacgagttcctaatagttgtatttctaaagatgtgtttcctagagaatgtacagccttatgacactgtagtgatgtttttataattttctaagtagatttttttatattaacaaattcatatacagaaaaaataaggtgttacaaaaaa

SEQ ID NO: 127591 - DNA, 2246 bp, Homo sapiens
  Payload ID: 4971
  Gene Symbol: DRAM2
  Gene Name: DNA-damage regulated autophagy modulator 2
  Uniprot ID: Q6UX65
  ENST ID: ENST00000286692
  CDS Start-End: 619-1419
aaggtaagtcgaagtaggggagaagggacaggccccagcgcttgcagcccgctccctctagaagggtgcgtcagagggtgggatctggcagctcggggaagtgggcgcagcctggagcccccttacccgcgtcgcaggcgcgcgagactcctgctggccctcattgcctccgggggctaccttatgccaggcgccagaggggggctggttggggcgggagctgcgggggtttccgggggcggggatgagtgcagctgggctcagctccccgtgccctacctttctgttctcttccttggtttcccctactctcctcctgccccaagcagtgcctgatgccgagttccgtctctcgcgtcttttcctggtcccaggcaaagcggagcggagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatgatatcatagttttttataccttatttaagagaaacaacctgacgtgcaccaatcagtctgcacatcccaacccttcacattttataaattattgtagatcatgttttgttaggagcacttttatgagagacattttccatgactaaataatcagcattagtcagtaaatcctttagaactgggttttgaaatgggagttttatcatattaaatcatttcttgtagtcttacattttttgttgttgttctggaatctacctgtaaaggaaagtagacctggattcatgtgggctcttccatggcttaagtgttgcccaagagattttgtaggtaacgatttttttttttctggccacaatgccagatactaagctaattggtctatcatacacatgcttgcagtagtttcatgaagtttagtctctggcgtgaaattttaatcaccaatgaaggagagaggcacctgtaggtaaatttactttagtcatattttatataaaacaagggttagtattcatgtaacattgagaagtttgggaataacagcagatatgattaataaaagtcataaccat

SEQ ID NO: 127592 - DNA, 1883 bp, Homo sapiens
  Payload ID: 4971
  Gene Symbol: DRAM2
  Gene Name: DNA-damage regulated autophagy modulator 2
  Uniprot ID: Q6UX65
  ENST ID: ENST00000539140
  CDS Start-End: 258-1058
gcgattgccgtaaaggggaacaaggtttgaacgagcagcgccgcaggcgcgctcctcggtgccgtgagcgcgccccggggccggccggtctgctcgggagcgcgccccgtggcccagccctgtctccttttagcataggggcttcggcgccagcggccagcgctagtcggtctggtaaggatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatgatatcatagttttttataccttatttaagagaaacaacctgacgtgcaccaatcagtctgcacatcccaacccttcacattttataaattattgtagatcatgttttgttaggagcacttttatgagagacattttccatgactaaataatcagcattagtcagtaaatcctttagaactgggttttgaaatgggagttttatcatattaaatcatttcttgtagtcttacattttttgttgttgttctggaatctacctgtaaaggaaagtagacctggattcatgtgggctcttccatggcttaagtgttgcccaagagattttgtaggtaacgatttttttttttctggccacaatgccagatactaagctaattggtctatcatacacatgcttgcagtagtttcatgaagtttagtctctggcgtgaaattttaatcaccaatgaaggagagaggcacctgtaggtaaatttactttagtcatattttatataaaacaagggttagtattcatgtaacattgagaagtttgggaataacagcagatatgattaataaaagtcataacc

SEQ ID NO: 127593 - DNA, 767 bp, Homo sapiens
  Payload ID: 4971
  Gene Symbol: DRAM2
  Gene Name: DNA-damage regulated autophagy modulator 2
  ENST ID: ENST00000496430
  CDS Start-End: 132-332
gtctccttttagcataggggcttcggcgccagcggccagcgctagtcggtctggatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccagaaaaatgcttatttggggcaatgctaaatattgcggcagttttatagtaaacgtttactacttaattaaagtgaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactg

SEQ ID NO: 127594 - DNA, 906 bp, Homo sapiens
  Payload ID: 4972
  Gene Symbol: DDIT3
  Gene Name: DNA-damage-inducible transcript 3
  Uniprot ID: P35638
  ENST ID: ENST00000346473
  CDS Start-End: 181-690
gaggtcagagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatga

SEQ ID NO: 127595 - DNA, 872 bp, Homo sapiens
  Payload ID: 4972
  Gene Symbol: DDIT3
  Gene Name: DNA-damage-inducible transcript 3
  Uniprot ID: P35638
  ENST ID: ENST00000547303
  CDS Start-End: 142-651
actgagcgtatcatgttaaagatgagcgggtggcagcgacagagccaaaatcagagctggaacctgaggagagagtgttcaagaaggaagtgtatcttcatacatcaccacacctgaaagcagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgagccaa

SEQ ID NO: 127596 - DNA, 644 bp, Homo sapiens
  Payload ID: 4972
  Gene Symbol: DDIT3
  Gene Name: DNA-damage-inducible transcript 3
  ENST ID: ENST00000547526
  CDS Start-End: 210-644
agagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagtacaactttacctacaaaaacaggcatcagaccagcttgccaacttgtggcatagactgtttgctacatggagcttgttccagccactccccattatcctgcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggag

SEQ ID NO: 127597 - DNA, 951 bp, Homo sapiens
  Payload ID: 4972
  Gene Symbol: DDIT3
  Gene Name: DNA-damage-inducible transcript 3
  Uniprot ID: P35638
  ENST ID: ENST00000552740
  CDS Start-End: 373-951
agagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcaggtaaacttaacctacccttttccaaaaattttaaacggcaggacagtaaatattttagatgttaaaagtcctatagtctctagcgtgactcttcatctctgccactgtagcaccaaagcagccataaacaatatgtaaataaacagatgtggctgtattccagtacaactttacctacaaaaacaggcatcagaccagcttgccaacttgtggcatagactgtttgctacatggagcttgttccagccactccccattatcctgcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatga

SEQ ID NO: 127598 - DNA, 1067 bp, Homo sapiens
  Payload ID: 4972
  Gene Symbol: DDIT3
  Gene Name: DNA-damage-inducible transcript 3
  Uniprot ID: P35638
  ENST ID: ENST00000551116
  CDS Start-End: 269-847
gaggtcagagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagcaccaaagcagccataaacaatatgtaaataaacagatgtggctgtattccagtacaactttacctacaaaaacaggcatcagaccagcttgccaacttgtggcatagactgtttgctacatggagcttgttccagccactccccattatcctgcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgagcca

SEQ ID NO: 127599 - DNA, 895 bp, Homo sapiens
  Payload ID: 4972
  Gene Symbol: DDIT3
  Gene Name: DNA-damage-inducible transcript 3
  ENST ID: ENST00000618206
  CDS Start-End: 175-681
agagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagatgtgcttttccagactgatccaactgcagagatggcagctgagtcattgcctttctcctcggacactgtcagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctat

SEQ ID NO: 127600 - DNA, 1748 bp, Homo sapiens
  Payload ID: 4973
  Gene Symbol: DDIT4
  Gene Name: DNA-damage-inducible transcript 4
  Uniprot ID: Q9NX09
  ENST ID: ENST00000307365
  CDS Start-End: 202-900
gggcgcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 127601 - DNA, 2604 bp, Homo sapiens
  Payload ID: 4974
  Gene Symbol: DDIT4L
  Gene Name: DNA-damage-inducible transcript 4-like
  Uniprot ID: Q96D03
  ENST ID: ENST00000273990
  CDS Start-End: 216-797
gctactgcgaggagccggcgcagggtggcccgggaggggtgagcagggtgccgctggctgctggggtctgcaggtcaccgagtccccaggagaggggactcctaagaagccacctgcctgtgtttacccggcagcgagcgcgcaggcccccgcgaactcctggcagcgctcaggaaaggccgttgcgcctcgcgaaggaaacagagccgttgaccatggttgcaactggcagtttgagcagcaagaacccggccagcatttcagaattgctggactgtggctatcacccagagagcctgctaagtgattttgactactgggattatgttgttcctgaacccaacctcaacgaggtaatatttgaggaatcaacttgccagaatttggttaaaatgctggagaactgtctgtccaaatcaaagcaaactaaacttggttgctcaaaggtccttgtccctgagaaactgacccagagaattgctcaagatgtcctgcggctttcctcaacggagccctgcggcttgcgaggttgtgttatgcacgtgaacttggaaattgaaaatgtatgtaaaaagctggataggattgtgtgtgattctagcgtcgtacctacttttgagcttacacttgtgtttaagcaggagaactgctcatggactagcttcagggactttttctttagtagaggtcgcttctcctctggtttcaggagaactctgatcctcagctcaggatttcgacttgttaagaaaaaactttactcactgattggaacaacagtgattgaagggtcctaaaaagggaaaatatataaagattatttcatgattgggtagtaaaactattcagctagtcagctaaagtcatttgtagtttgccccacctgccctaaataagaaaccccaaatgtagtctcttttctttctgtgtttcacattcatagcaactgcagctaacaggctgattttctggcctttggagaagtgattcaaaatagtgtagattttctgcatagatcccatttttgtacagaattgaatgggatggaataggtaagcaaaagtagaagcccatttgagttttacatttgattccacaatttggtttcaggtaggcttggtaatagactatataaaccagatttgcctattttgattttcatatggcttttttttctgtaagttttcagaggattttttaaatcacagaatcatactaaatgatatttagcctatcaaaacttccaaaagcccacaccaccagttcctgactcaaatttgaagggtttttagacaggagggtaggattaagtaggtgagtttaattaaagcttaaccctaggtaagagtaaatgagaaatattacggcaataatggaactgcttcactgtttcttggtgacttcctcactctaatgttttaaagaggcaacaaaagcttgtggtgccatttcagtaaccacggtgttgttttagatgcctttataagctcagtttcccctgttcttaagtgttgaatactgtctttaaactagaaaaatgcaaaatattgaactgatatttttgtgtgtagttgattactcttccattgagtgaatgatgaatacctgtgaggataggaaattagttctgagatctagtccctctctgattcacttagtaatctatcctcttttcagtattacatgtgcttaatctcagatgaaccatttcaccatggcagtgttatctcatctctgggcttttctgggaattgaagtatctctccttaaccccaattgtcaagggtagtagctgtatactaccactttgaattattgaaacgggtcaatttacgaagtctgcattggctatggagatatggtttatagtacagcctagagaatgaaactcaccgtccagataaccatgcatgcacccagattttttccaccttggatacctgtcactagggaataataaaggcctgattttttgtcttattccaactaagtagatcattatctctttccttttttatgttaatgagagaatttagcctccactcaacaatgttcaattcagcaaggctttcatatccttgctgtgggtcgtggataaggagcttattcaggtttcctgccctagctattagctccacttcacatgctggagaccggcgtagggacagatgtattcatcctggtgttactgaaaaacaggtgtgatcctgttactgatactataagtgacctaaaatgtcactgttcaaattagccagtgttctaacaaactaaactcttcaaatgcttggaaagatactacaaagccaatctttatagaattgggccaagataaatctatgttgttttgcatggctattgttaagctccaaaggttcactgtgtttctgccgctgtcctggagttgtcaccactgactgggcaaggcttcttgggcatggatgtagaactgttgtccttttcccactaacagttatctttgactctcttgcctgttatgcttacaaaatggtgatggcttatggaaggctgttaaattaatattcctgttaaaggaaattaaagtttgtctatttttgacaataaaacattatatatttttaa

SEQ ID NO: 127602 - DNA, 553 bp, Homo sapiens
  Payload ID: 4974
  Gene Symbol: DDIT4L
  Gene Name: DNA-damage-inducible transcript 4-like
  ENST ID: ENST00000513992
  CDS Start-End: 170-553
gagtgtgaaagcgcggacgctcggggaggggtcgcactgaacaatcaggttcaggctttgacgagtcgtgcacccggaattgcggtcccagtggcccgagatctaccctggaagcaacagcgctcaggaaaggccgttgcgcctcgcgaaggaaacagagccgttgaccatggttgcaactggcagtttgagcagcaagaacccggccagcatttcagaattgctggactgtggctatcacccagagagcctgctaagtgattttgactactgggattatgttgttcctgaacccaacctcaacgaggtaatatttgaggaatcaacttgccagaatttggttaaaatgctggagaactgtctgtccaaatcaaagcaaactaaacttggttgctcaaaggtccttgtccctgagaaactgacccagagaattgctcaagatgtcctgcggctttcctcaacggagccctgcggcttgcgaggttgtgttatgcacgtgaacttggaaattgaaaatgtatgtaaaaagctggataggattgtgtgtgattct

SEQ ID NO: 127603 - DNA, 852 bp, Homo sapiens
  Payload ID: 4974
  Gene Symbol: DDIT4L
  Gene Name: DNA-damage-inducible transcript 4-like
  ENST ID: ENST00000502763
  CDS Start-End: 322-852
aggtgagcgaagctgcggccttggtgggggcagcggggccggggggcgctccgcggggcaggtcgcttccaagttttgcgaactgttgagttagtttcaggttgcggctccgctcccagggctttgtcaaattgagttgcagaggccggttccacccctttggcaaaggagttcctccgctagttcgctcccgggacgccgggcattttaggagcctctgcacgactcgcctgcttttgcaaatccgtctcttctcgcctcattttttccagcgctcaggaaaggccgttgcgcctcgcgaaggaaacagagccgttgaccatggttgcaactggcagtttgagcagcaagaacccggccagcatttcagaattgctggactgtggctatcacccagagagcctgctaagtgattttgactactgggattatgttgttcctgaacccaacctcaacgaggtaatatttgaggaatcaacttgccagaatttggttaaaatgctggagaactgtctgtccaaatcaaagcaaactaaacttggttgctcaaaggtccttgtccctgagaaactgacccagagaattgctcaagatgtcctgcggctttcctcaacggagccctgcggcttgcgaggttgtgttatgcacgtgaacttggaaattgaaaatgtatgtaaaaagctggataggattgtgtgtgattctagcgtcgtacctacttttgagcttacacttgtgtttaagcaggagaactgctcatggactagcttcagggactttttctttagtagaggtcgcttctcctctggtttcaggagaactctgatcctcagctcaggatttcgacttgtt

SEQ ID NO: 127604 - DNA, 1598 bp, Homo sapiens
  Payload ID: 4975
  Gene Symbol:
  Gene Name: DNA-directed RNA polymerase II subunit RPB11-b1 [Source:UniProtKB/Swiss-Prot Acc:Q9GZM3]
  Uniprot ID: Q9GZM3
  ENST ID: ENST00000476151
  CDS Start-End: 41-388
tggcggacacttggggtctggacgcaacggcggcgggagcatgaacgcccctccagccttcgagtcgttcttgctcttcgagggcgagaagatcaccattaacaaggacaccaaggtacccaaggcctgcttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatc

SEQ ID NO: 127605 - DNA, 2381 bp, Homo sapiens
  Payload ID: 4976
  Gene Symbol: DNAJA1
  Gene Name: DnaJ (Hsp40) homolog, subfamily A, member 1
  Uniprot ID: P31689
  ENST ID: ENST00000330899
  CDS Start-End: 184-1377
ggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagcatctccaa

SEQ ID NO: 127606 - DNA, 3122 bp, Homo sapiens
  Payload ID: 4977
  Gene Symbol: DNAJA2
  Gene Name: DnaJ (Hsp40) homolog, subfamily A, member 2
  Uniprot ID: O60884
  ENST ID: ENST00000317089
  CDS Start-End: 217-1455
aatacttcgaccccagtggccgcgcctcgggcgctcgggggcgggctctgcacagcgacgtcacggcgcaccgtgcgctgggtcaaagttcagccccgcccccgcttccccctcgctgtctccctcggcctgtgccgccgccgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaacaagactccctttcacacatggattattataagtttcaatcctggtatctgtgcttgatttttatcagttttgtgtagatttttatgtttcatattttaaatttaaatcccacattgtaaagtttgtacaatttgtcctgaagctttgtgtttggctgcacctgcataagctgctacaaatagaataaagaatttcatagcctgtatctatcatttagatgcatggaaaaaaatgggctttgcacacaatgggtttggagctgactgggaacaatggaaaaaattacattagctgtggttgtaaagtttttttgtttttggttttgttttttttttcttttttctttttttttttttttaccatcttgtgaaaggtttctgaaactcgataataaaaagcggttggtgtaaattattcttttgtgtcacatttttagaaggaaaaacataaaagaatgtatccttagtactggttcttaaacagcccataaaaacccattggcctgaagcttatatctcaggcctatgcccatcttatagtcttggaagacaaaaggctggtagagacagtcttcagtggcttcagtgatgctctgtagaggccagggtgtcttgagtgctgtaactcccaagcactgggctagcctgacttctgtatctccctaccaccacccccttaaaaaaataaggtaacagcaaatctatagtaaaaccatgtctgcatagaacgtgttcaaatcctctgttttcattaaatgtaaaagatgctgtctccattaagttgaatatttggaattggagaagccattgattattattttgagtttctgtaatgttttatagaaaagtaagatgcttattcagaatttaagaatgaaggcaactgaaatatgcattgttgtagttatttatatttcaaactaaaaataagcaaaaaaaaaaggctggtttgagaaaaatcaggtaaaattgatgaaacggatgttgtgtttctctttccatcatctggtttttaccatttcactcagtaggtatttttagaacacacttatttgaggaaagagacatcagatgcacaattttacatttataaaggaacaaatggggaaaactgaaaactaaaaattttaaatgtattaaatgccatccctgagcctaaatctagtatttgtagtttatttctaggtctgctagaacctgaaaacctgaatgaaaaaaggtgtgctgacactaatcaagtcctgtgaggtttaaattattgacctatccactctacctccattgtacaaaaaatattttacaacaagcctgggtaagattcaacagcatagtagttttgtatccaaggttacttccccacaaccactttaaacataagaaatgtggtggcaatataaagtttgtagcctttccaataaaggtttataaaacagtt

SEQ ID NO: 127607 - DNA, 1825 bp, Homo sapiens
  Payload ID: 4977
  Gene Symbol: DNAJA2
  Gene Name: DnaJ (Hsp40) homolog, subfamily A, member 2
  ENST ID: ENST00000563158
  CDS Start-End: 93-236
tcggcctgtgccgccgccgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaaaattaaatggattctggattcctgtagcttctccccactcttctacttgaaaatgcaattatttttatttttaccttttctttatagtttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaacaagactccctttcacacatggattattataagtttcaatcctggtatctgtgcttgatttttatcagttttgtgtagatttttatgtttcatattttaaatttaaatcccacattgtaaagtttgtacaatttgtcctgaagctttgtgtttggctgcacctgcataagctgct

SEQ ID NO: 127608 - DNA, 1885 bp, Homo sapiens
  Payload ID: 4977
  Gene Symbol: DNAJA2
  Gene Name: DnaJ (Hsp40) homolog, subfamily A, member 2
  ENST ID: ENST00000617000
  CDS Start-End: 1483-1885
tctctgcgtccctcgcccattgacccggaggtagctgggtctgtgtttggatgcattgttctttgggcaggtaatgctaatgtcctgtacctgcttaggaataagccgtggtcccagccaaacgcctgagtgtacagtaaacataaatagaaggccttattattgctatttgcaatgctgcgatatctttcatctcaggatttcaaagcacacgaggcatttaagccccacagcatcctcaccaggctaagagcatccagatttgtaagccgagaaaaatgagaatgctccttaggcagtgagaagagtacagtggacttcctgttaccttaccggaaatgctagtctgtattatataattcacgagcctccgtgaatgaagatttaagtgctttaggacccaaacacctcgttgagagtgtgtgcaacttctctaccaccgaagttgccaccacgaccccagttaaccaccacgtgcaaataaaacaccaaaagacgctaactaggaccacctttactttttcatgatgttacagttagaaggaaggcgtgagccatcgggagcaggaattgtgactttagcttgatttatagtaatgttttgcagtccgcaaagcttaacagtcatttatctcgaatttattagggtcgtcttggtctggttacttggccatcaaagacacttgacaatagggaaaatatggataatgtttgaacgttttgtttttccctgtggcattgcttcattgttttatctggttttcacgtcactgtaacctgttttcaagtatagctgctgtctacttggttatattacattagtaaacagtatcgcgagaaagtgccgaagaatccctacgaatagaaaatatttttgaaaggttataactctagaacattacttctcagaaaagtggatattaagttattacaaaacttttaactggtgtttagttataaccttttttgtttttatccattttcaaaggcatacagaaagttagccaaggaatatcatcctgataagaatccaaatgcaggagacaaagtaagttatttgcaccttttttattccgggggttttagctttaacttaaattgccctccttgaaaaagaggaatgttgcaggaaaaaaatccaactatgcccacacagccacattttcataatgtcaagagtattttagttttagaataagagtactaccattctgaggagcggtgggtggtaaatagaaccagaatcaagtcaaaggtaacttgtccctttttttttttttttagaattaaatggattctggattcctgtagcttctccccactcttctacttgaaaatgcaattatttttatttttaccttttctttatagtttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttg

SEQ ID NO: 127609 - DNA, 2763 bp, Homo sapiens
  Payload ID: 4978
  Gene Symbol: DNAJA3
  Gene Name: DnaJ (Hsp40) homolog, subfamily A, member 3
  Uniprot ID: Q96EY1
  ENST ID: ENST00000262375
  CDS Start-End: 78-1520
cgcctctacgcgcgcccgccgttcccgcgaggcccacctagagccgggcggcgcaggcgcagagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagccttacaggaacaaaacataaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggtacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggtggcagcaccatggatagctccgcaggaagcaaggctaggcgtgaggctggggaggacgaggagggattcctttccaaacttaagaaaatgtttacctcatgatatcccagccgaggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccgggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaaa

SEQ ID NO: 127610 - DNA, 2591 bp, Homo sapiens
  Payload ID: 4978
  Gene Symbol: DNAJA3
  Gene Name: DnaJ (Hsp40) homolog, subfamily A, member 3
  Uniprot ID: Q96EY1
  ENST ID: ENST00000355296
  CDS Start-End: 23-1384
ggcgcagagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagccttacaggaacaaaacataaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggtacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccgggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaaa

SEQ ID NO: 127611 - DNA, 2294 bp, Homo sapiens
  Payload ID: 4978
  Gene Symbol: DNAJA3
  Gene Name: DnaJ (Hsp40) homolog, subfamily A, member 3
  Uniprot ID: Q96EY1
  ENST ID: ENST00000431375
  CDS Start-End: 188-1090
cgcctctacgcgcgcccgccgttcccgcgaggcccacctagagccgggcggcgcaggcgcagagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagccttacaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggtacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccgggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacct

SEQ ID NO: 127612 - DNA, 837 bp, Homo sapiens
  Payload ID: 4978
  Gene Symbol: DNAJA3
  Gene Name: DnaJ (Hsp40) homolog, subfamily A, member 3
  ENST ID: ENST00000575106
  CDS Start-End: 18-386
agagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagccttacaggtggagtcttgctctgtcgcccaggctggagtgcaatggcgcgatcttggctcactgcaacctcagcctcccaggaacaaaacataaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaa

SEQ ID NO: 127613 - DNA, 558 bp, Homo sapiens
  Payload ID: 4978
  Gene Symbol: DNAJA3
  Gene Name: DnaJ (Hsp40) homolog, subfamily A, member 3
  ENST ID: ENST00000574895
  CDS Start-End: 4-558
aagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagccttacaggaacaaaacataaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgagtacttcatggagttgacattcaatcaagctgcaaagggggtcaacaaggagttcaccgtgaacatcatggacacgtgtgagcgctgcaacggcaaggggaacgagcccggcaccaaggtgcagcat

SEQ ID NO: 127614 - DNA, 1413 bp, Homo sapiens
  Payload ID: 4978
  Gene Symbol: DNAJA3
  Gene Name: DnaJ (Hsp40) homolog, subfamily A, member 3
  ENST ID: ENST00000576911
  CDS Start-End: 18-314
agagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagccttacaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggtacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagc

SEQ ID NO: 127615 - DNA, 554 bp, Homo sapiens
  Payload ID: 4978
  Gene Symbol: DNAJA3
  Gene Name: DnaJ (Hsp40) homolog, subfamily A, member 3
  ENST ID: ENST00000570857
  CDS Start-End: 18-251
agagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagccttacagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggt

SEQ ID NO: 127616 - DNA, 2763 bp, Homo sapiens; identical to SEQ ID NO: 127609
  Payload ID: 4978
  Gene Symbol: DNAJA3
  Gene Name: DnaJ (Hsp40) homolog, subfamily A, member 3
  Uniprot ID: Q96EY1
  ENST ID: ENST00000612103
  CDS Start-End: 78-1520

SEQ ID NO: 127617 - DNA, 2591 bp, Homo sapiens; identical to SEQ ID NO: 127610
  Payload ID: 4978
  Gene Symbol: DNAJA3
  Gene Name: DnaJ (Hsp40) homolog, subfamily A, member 3
  Uniprot ID: Q96EY1
  ENST ID: ENST00000614397
  CDS Start-End: 23-1384

SEQ ID NO: 127618 - DNA, 1413 bp, Homo sapiens; identical to SEQ ID NO: 127614
  Payload ID: 4978
  Gene Symbol: DNAJA3
  Gene Name: DnaJ (Hsp40) homolog, subfamily A, member 3
  ENST ID: ENST00000615114
  CDS Start-End: 18-314

SEQ ID NO: 127619 - DNA, 558 bp, Homo sapiens; identical to SEQ ID NO: 127613
  Payload ID: 4978
  Gene Symbol: DNAJA3
  Gene Name: DnaJ (Hsp40) homolog, subfamily A, member 3
  ENST ID: ENST00000633931
  CDS Start-End: 4-558

SEQ ID NO: 127620 - DNA, 554 bp, Homo sapiens; identical to SEQ ID NO: 127615
  Payload ID: 4978
  Gene Symbol: DNAJA3
  Gene Name: DnaJ (Hsp40) homolog, subfamily A, member 3
  ENST ID: ENST00000631547
  CDS Start-End: 18-251

SEQ ID NO: 127621 - DNA, 837 bp, Homo sapiens; identical to SEQ ID NO: 127612
  Payload ID: 4978
  Gene Symbol: DNAJA3
  Gene Name: DnaJ (Hsp40) homolog, subfamily A, member 3
  ENST ID: ENST00000633082
  CDS Start-End: 18-386

SEQ ID NO: 127622 - DNA, 2961 bp, Homo sapiens
  Payload ID: 4979
  Gene Symbol: DNAJA4
  Gene Name: DnaJ (Hsp40) homolog, subfamily A, member 4
  Uniprot ID: Q8WW22
  ENST ID: ENST00000343789
  CDS Start-End: 32-1225
agtgcggtggagccaggcgtggaaacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaatactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccagtgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagagataa

SEQ ID NO: 127623 - DNA, 3116 bp, Homo sapiens
  Payload ID: 4979
  Gene Symbol: DNAJA4
  Gene Name: DnaJ (Hsp40) homolog, subfamily A, member 4
  Uniprot ID: Q8WW22
  ENST ID: ENST00000394852
  CDS Start-End: 191-1384
ccaggcgtggaagtcggtccggcgcggggcggggggcgggcgggagctacaagcggcggcggcggcggcgaccgtgaccgtgacgcgcgagcgggcggcgggggcgcgggccaggggcgcgggccagggtgccggcaggggcgtccggggcgctctgaccggcctcgcccgccccccccgcagacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaatactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccagtgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagag

SEQ ID NO: 127624 - DNA, 3245 bp, Homo sapiens
  Payload ID: 4979
  Gene Symbol: DNAJA4
  Gene Name: DnaJ (Hsp40) homolog, subfamily A, member 4
  Uniprot ID: Q8WW22
  ENST ID: ENST00000394855
  CDS Start-End: 229-1509
agacggcggccacacccccggggagaggccgggtggggaccgcagggcgcagctctcccagtcccacccttcggcgcagggctccggccaacacagccctccaggccgcctactctccagccagccggctccacggacccacggaagggcaagggggcggcctcggggcggcgggacagttgtcggagggcgccctccaggcccaagccgccttctccggcccccgccatggcccggggcggcagtcagagctggagctccggggaatcagacgggcagccaaaggagcagacgcccgagaagcccagacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaatactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccagtgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagagataa

SEQ ID NO: 127625 - DNA, 1308 bp, Homo sapiens
  Payload ID: 4979
  Gene Symbol: DNAJA4
  Gene Name: DnaJ (Hsp40) homolog, subfamily A, member 4
  ENST ID: ENST00000440911
  CDS Start-End: 50-685
ggaggagccggtggctctagtgcggtggagccaggcgtggaaacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaa

SEQ ID NO: 127626 - DNA, 514 bp, Homo sapiens
  Payload ID: 4979
  Gene Symbol: DNAJA4
  Gene Name: DnaJ (Hsp40) homolog, subfamily A, member 4
  ENST ID: ENST00000423642
  CDS Start-End: 32-376
agtgcggtggagccaggcgtggaaacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacat

SEQ ID NO: 127627 - DNA, 1399 bp, Homo sapiens
  Payload ID: 4979
  Gene Symbol: DNAJA4
  Gene Name: DnaJ (Hsp40) homolog, subfamily A, member 4
  Uniprot ID: Q8WW22
  ENST ID: ENST00000446172
  CDS Start-End: 63-1175
agtctcctttaaggagagcttgtaggcttctaatttcacatttcagcaagctggctaaagacatgtgggaaagcctgaccctggattcaggtcaaatctcagcactcacaagatttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgca

SEQ ID NO: 127628 - DNA, 947 bp, Homo sapiens
  Payload ID: 4979
  Gene Symbol: DNAJA4
  Gene Name: DnaJ (Hsp40) homolog, subfamily A, member 4
  ENST ID: ENST00000489435
  CDS Start-End: 170-589
agtcccacccttcggcgcagggctccggccaacacagccctccaggccgcctactctccagccagccggctccacggacccacggaagggcaagggggcggcctcggggcggcgggacagttgtcggagggcgccctccaggcccaagccgccttctccggcccccgccatggcccggggcggcagtcagagctggagctccggggaatcagacgggcagccaaaggagcagacgcccgagaagcccagacacaagatggtgaaggagacccagtactatgacatcctgggcgtgaagcccagcgcgtccccggaggagatcaagaaggcctatcggaagctggcgctcaagtaccacccggacaagaacccggatgagggcgagaagggacacggacatctgcaacctgacatcagcttgtactcatattctgggttttcggtgacaagtgacacacagttgatcataagtaccaatcatagactgaaaatgctctgcattttagagacagaagttaaaagcttttccatcctgtttacagaaagtttgctttttatctctaaagaggctcatgacccacctgaataggtgaattgaaggatgaggcattgcaaggaaaggctgctaaccctcccgttcctcctttcacttcttgccattttcttacaaaactttggttgttccgcatgggtcttgagaggtggggccgttatagtagctgatagcagtgtcacttgggccacgtttgaaaccacaccaatcacccatgtagcatttaagacctgtggaaacgacgctggaatcaaaatacctgtctgtgttagttgttccaagctggagaaagctacttcaggacggttggctgaatggcaacagtgatggaatatttatatttagccacatgtgctgaatgtggctgtcacaagtttaaaatgctttcctgtaa

SEQ ID NO: 127629 - DNA, 866 bp, Homo sapiens
  Payload ID: 4979
  Gene Symbol: DNAJA4
  Gene Name: DnaJ (Hsp40) homolog, subfamily A, member 4
  ENST ID: ENST00000542636
  CDS Start-End: 156-317
gcgggcgggagctacaagcggcggcggcggcggcgaccgtgaccgtgacgcgcgagcgggcggcgggggcgcgggccaggggcgcgggccagggtgccggcaggggcgtccggggcgctctgaccggcctcgcccgccccccccgcagacacaagatggtgaaggagacccagtactatgacatcctgggcgtgaagcccagcgcgtccccggaggagatcaagaaggcctatcggaagctggcgctcaagtaccacccggacaagaacccggatgagggcgagaaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagc

SEQ ID NO: 127630 - DNA, 1320 bp, Homo sapiens
  Payload ID: 4979
  Gene Symbol: DNAJA4
  Gene Name: DnaJ (Hsp40) homolog, subfamily A, member 4
  ENST ID: ENST00000483802
  CDS Start-End: 32-691
agtgcggtggagccaggcgtggaaacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaa

SEQ ID NO: 127631 - DNA, 2264 bp, Homo sapiens
  Payload ID: 4980
  Gene Symbol: DNAJB1
  Gene Name: DnaJ (Hsp40) homolog, subfamily B, member 1
  Uniprot ID: P25685
  ENST ID: ENST00000254322
  CDS Start-End: 72-1094
agagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctc

SEQ ID NO: 127632 - DNA, 1287 bp, Homo sapiens
  Payload ID: 4980
  Gene Symbol: DNAJB1
  Gene Name: DnaJ (Hsp40) homolog, subfamily B, member 1
  Uniprot ID: P25685
  ENST ID: ENST00000396969
  CDS Start-End: 274-996
aagcgacggttaggccagacgcgggggcggggtaagaagttgagtgacaggcaaggcagcatccacatgacaggcggcgccgaaggggtaaattctgagatcctgcccctgagctttcatgagctgttgaaccatctggaattcacaggcctgtcatgagagacacgatgagaagtccttaaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccct

SEQ ID NO: 127633 - DNA, 569 bp, Homo sapiens
  Payload ID: 4980
  Gene Symbol: DNAJB1
  Gene Name: DnaJ (Hsp40) homolog, subfamily B, member 1
  ENST ID: ENST00000595139
  CDS Start-End: 82-569
gttcctgtgcccgttgatgattcaggctggcttctgggcttgatctggagctgactttttgtgcaaggatggtggcagtgaatgctaatgtgcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaa

SEQ ID NO: 127634 - DNA, 593 bp, Homo sapiens
  Payload ID: 4980
  Gene Symbol: DNAJB1
  Gene Name: DnaJ (Hsp40) homolog, subfamily B, member 1
  ENST ID: ENST00000596853
  CDS Start-End: 244-593
gtacaccgggaacagcaggagagggctaggggctggggtcgcgggctgcggagtctggttggcgaggagatcctgcccctgagctttcatgagctgttgaaccatctggaattcacaggcctgtcatgagagacacgatgagaagtccttaaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaa

SEQ ID NO: 127635 - DNA, 995 bp, Homo sapiens
  Payload ID: 4980
  Gene Symbol: DNAJB1
  Gene Name: DnaJ (Hsp40) homolog, subfamily B, member 1
  ENST ID: ENST00000594099
  CDS Start-End: 674-995
aaagaaggaaaaagaatgggtcagcagtggccacacggcccctgtttctcgcttcttacctcgtaatgcttcatggctccctcccacggcggctactgctccgcggctgctgctgcctaactgcgcggcacagcacaggctccctacagcgctcgcaaccgcagcgatagactaaacgcggctctgcgtccgccccgcccctccaggccgcgcgcgccccgtcggccaatcagggcacgaggcgcccacgttcgcccctgctccttggggccggtccgaaccaagactaggactagcaccaggggattgaccaatcaacttgcgagaccaatcgaagggggcggaacgcctgtaggaggggctaaagagaaggggcttgaccatccaccaatccaaaggaggtctctgccccgcgcgtccctttgccacgccccctgatggcgtcgctgtggaaaccaagatcctgcccctgagctttcatgagctgttgaaccatctggaattcacaggcctgtcatgagagacacgatgagaagtccttaaaggtagatcactgattcacaggggagcaggcggaggcaagggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaag

SEQ ID NO: 127636 - DNA, 601 bp, Homo sapiens
  Payload ID: 4980
  Gene Symbol: DNAJB1
  Gene Name: DnaJ (Hsp40) homolog, subfamily B, member 1
  ENST ID: ENST00000595992
  CDS Start-End: 254-601
gttaggccagacgcgggggcggggtaagaagttgagtgacaggcaaggcagcatccacatgacaggcggcgccgaagggatcctgcccctgagctttcatgagctgttgaaccatctggaattcacaggcctgtcatgagagacacgatgagaagtccttaaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaacc

SEQ ID NO: 127637 - DNA, 882 bp, Homo sapiens
  Payload ID: 4980
  Gene Symbol: DNAJB1
  Gene Name: DnaJ (Hsp40) homolog, subfamily B, member 1
  ENST ID: ENST00000598235
  CDS Start-End: 333-882
cgacggggacggcgcggcggagcccgctgcggacccgggctcacctgggctcggccgccggggtccgcggggcggcgcctccggctcagctgcggggcgaggggttgtgaatgcaggagccgaccccgttcgtgggcttgggggctgggttgggataattcccgggaagtgatgacctggccccggcagggcacgcaggaggcagcggccgcccaggtccggagagcggggccgcctcggagggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcg

SEQ ID NO: 127638 - DNA, 573 bp, Homo sapiens
  Payload ID: 4980
  Gene Symbol: DNAJB1
  Gene Name: DnaJ (Hsp40) homolog, subfamily B, member 1
  ENST ID: ENST00000596075
  CDS Start-End: 335-573
agcatccacatgacaggcggcgccgaagggatcctgcccctgagctttcatgagctgttgaaccatctggaattcacaggcctgtcatgagagacacgatgagaagtccttaaaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtac

SEQ ID NO: 127639 - DNA, 573 bp, Homo sapiens
  Payload ID: 4980
  Gene Symbol: DNAJB1
  Gene Name: DnaJ (Hsp40) homolog, subfamily B, member 1
  ENST ID: ENST00000601533
  CDS Start-End: 301-573
aagcgacggttaggccagacgcgggggcggggtaagaagttgagtgacaggcaaggcagcatccacatgacaggcggcgccgaagggatcctgcccctgagctttcatgagctgttgaaccatctggaattcacaggcctgtcatgagagacacgatgagaagtccttaaaggtagatcactgattcacaggggagcaggcggaggcaagggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaac

SEQ ID NO: 127640 - DNA, 567 bp, Homo sapiens
  Payload ID: 4980
  Gene Symbol: DNAJB1
  Gene Name: DnaJ (Hsp40) homolog, subfamily B, member 1
  ENST ID: ENST00000598692
  CDS Start-End: 327-567
gtggaaaccaaggtaagcgacggttaggccagacgcgggggcggggtaagaagttgagtgacaggcaaggcagcatccacatgacaggcggcgccgaaggggtaaattctgagatcctgcccctgagctttcatgagctgttgaaccatctggaattcacaggcctgtcatgagagacacgatgagaagtccttaaaggtagatcactgattcacaggggagcaggcggaggcaagggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtacca

SEQ ID NO: 127641 - DNA, 1688 bp, Homo sapiens
  Payload ID: 4981
  Gene Symbol: DNAJB11
  Gene Name: DnaJ (Hsp40) homolog, subfamily B, member 11
  Uniprot ID: Q9UBS4
  ENST ID: ENST00000265028
  CDS Start-End: 221-1297
ttggctctcgcctaccgggggcttctctcaccgggactcgggactcccgggaagtggaccggcagaagagggggctagctagctgtctctgcggaccaaggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttatttttttcatg

SEQ ID NO: 127642 - DNA, 501 bp, Homo sapiens
  Payload ID: 4981
  Gene Symbol: DNAJB11
  Gene Name: DnaJ (Hsp40) homolog, subfamily B, member 11
  ENST ID: ENST00000418776
  CDS Start-End: 1-501
actagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggccgagtggtttgaggatgatgtcatacagcgcaagagggagctgtggcc

SEQ ID NO: 127643 - DNA, 2398 bp, Homo sapiens
  Payload ID: 4981
  Gene Symbol: DNAJB11
  Gene Name: DnaJ (Hsp40) homolog, subfamily B, member 11
  Uniprot ID: Q9UBS4
  ENST ID: ENST00000439351
  CDS Start-End: 930-2006
gagacctggcggaccccgttgctagagcggcagattgcggctcaagcgtctgagaaaatctaggctggggtcgagagtccgcaacagtggcacctggagccagacccaccgctttctggtgtcgcgcctttcaacccgggggggtaggaagctttctgttgctccgcataactgtggtcagctaatagctgctgcctttccgagacagttgtcttatggagttgcttggagaacgtaaaataagaggcctaagcaatgcgtctgatgtacacctgtcgtggaataactgttcccgctcattcggccgctgtacctctgctccctcattcggagcgtagctgggtatgaatgaaattccgggcttgtagcacagagaaaacttctctcccacaattggttggtgctggggaggaagctcctgattggtggaaagtccgaggaagtgggcaagccggagggatttcgtgtacctcaggtgccctcactctgaccggccccctatcattacgtaattttctacgactcgcggtagctcaggcagagcgggttcctgcagcggcgcgaccctctgacgtctccgcttctaattggtcaagagctgcgactgcagttctgaagcctaactggttgcccgtgccgcctcggaggtgaagtgtactgcgctgattggcttccaggcgccggccgcgtgtgatgtcccgggcaacgattggctctcgcctaccgggggcttctctcaccgggactcgggactcccgggaagtggaccggcagaagagggggctagctagctgtctctgcggaccaaggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttatttttttcatga

SEQ ID NO: 127644 - DNA, 228 bp, Homo sapiens
  Payload ID: 4981
  Gene Symbol: DNAJB11
  Gene Name: DnaJ (Hsp40) homolog, subfamily B, member 11
  ENST ID: ENST00000538831
  CDS Start-End: 1-228
atgggggtgaagctggagatatttcggatgataatctacctcactttccctgtggctatgttctgggtttccaatcaggccgagtggtttgaggatgatgtcatacagcgcaagagggagctgtggccacctgagaagcttcaagagttagaggaattcaaagagaggttacggaagcggaagcggcgggaggagaagctccttcgcgacgcccagcagaactcctga

SEQ ID NO: 127645 - DNA, 4360 bp, Homo sapiens
  Payload ID: 4982
  Gene Symbol: DNAJB12
  Gene Name: DnaJ (Hsp40) homolog, subfamily B, member 12
  ENST ID: ENST00000338820
  CDS Start-End: 151-1380
gttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaagtatgagccagggctgcctccaccctgcaactcctggcagctttggccctggtcatgagcagaggagggagggggagaaagggaggaagcctggtgattgtggcaaagactcctgtccccagcctgacctccagcctccagagaccgagcagctgtggggcctgctgggaaaccaaggtcggtttccgccctctagcgatgctgtcctccccactcctccgctctgctccctggctccaggggtgtgggggaccccagaaccaggcagagtgggaacttgaaactgttgctgagggccacccggggcttcttggtccactccagccatcagtcagcacggccctttctccagcacagcagactattgtccgtgccctggtatttaggccatcacatatggtggggcccaagagagccccatatgcacactgcctgcctgataccaggaagaaccatgtgggaataggtgggccaagagccctcccctttctccatccctccagctaggaggaaatggagcaagatgaacaggcagccacgaggtgggtgggagctggcagtcttggtggcggcaggggccgcgggccctgaccacccccctctggtgggatctgaggcactctctcgaatgccgtcacacctggcagcctggaagccacaggcatccggccttgcccaggcatctcgcctgcggtctgaggaagggaacagaaggtcatgagttcagggtcagacgcagccgctcagcacaggaggggtggaggggaaatgagagttgctggtagcaggctccctccttctgcagcccggcgaatgggggcgctgggctctgttcccagcgtttgccagaggtggccacttcagccaagcccagagaagtgtgggcagaagcagtgaaggttcttctctgtgtgggtgccctgcccaccccctcctttgcctgtgtcctcccggcctggatccatggctgactctgcctggaggccatttgtgcctgcctctgtgctgccgcaggagggcaggccgcaagtggggttggtgggggtcgagcgggcagcacggtgcagcggtgcagtggcaaggggggctacttgtgtggcataagctagaggagccggtgccgcctgaatgccgagctaactgttgccactctcctccccagactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttccctccctcgcagggctggcggaggctccgcatcgcctctctcctaggatacagaaaccatggcaacgaaagtagaatgtaaaactcgcagcagatatcagtgggaagggctgggggagggggcacccagctgcctttcctccctcacaggagccaccaccagccacctctcaggagaagccagaggccctggccaaagataggaggaagaaagagaactctccatagaatgtaatttatagatgcgtgtatatgtatatatatctatttatatgtaaataggcatatatgaagatatatatatatatagtctactttttaaactctgcagggatttggttaagttgttgagctgatttcttccatgttttagaaaatgaggcctgtttggggaaggtaccctggtgatgtttttgctagacattagctgtagctgacagcataaggagagtcgcatcagagcttttcacagccccccgaaaccccagcctggttttgatggcagcagtaatcatgatagtgtgaacccgcgaaggcctcaggattatggttaacctggagaggagcaggccatggaggcaggtgccaggtcagtattgagtcacagtagaggccccacaaggacctgcttgggtgagaccacctctcccctctcagcagcgctggtgggctctttgtcctggtgcccaggagccctccagccccctgcccacagaagggaaggcctgcagagggggccaggatctacctaaccatttccccacccctaagtccctcagtgggctttgccttataggtgccacagggcacagctccatcattgccactggtttttcctaagtcatgcaccaaggacttcagaaagttcttcctccgagtcagtcagtggtgccgggaccccagggcagcctcctcgactcctgaagaaaaggcagtgcccgtggctgcctctgtcttcactcgctgttgatgtgaccgccaggcctcctctcgtaccttggacaaaggatacacctgaaccagaatagttttcttaccctcacattgaaatgaggattttgcttaaaacagcacttgccgccagtgggaggagggaggttttatttattcccacagtttctcctgggccttctggaatgaccatgttttcctgtggcggtgggtgtgtcattgcgcccgccgtcttccaaagccttacttccccaagctgccagccaggaggtgataaccaccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggccccggtgctctgcccccacgccccgaccatctggtcttggtagatgtccctagacgggctgagccatgtgcaataagaacatagatcctaaaggatcctctggaagctgtatttcttgaattagaattctcaaattgtacatctgttaatatatgtttattatgtgactggc

SEQ ID NO: 127646 - DNA, 3198 bp, Homo sapiens
  Payload ID: 4982
  Gene Symbol: DNAJB12
  Gene Name: DnaJ (Hsp40) homolog, subfamily B, member 12
  ENST ID: ENST00000394903
  CDS Start-End: 151-1380
gttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaaactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttccctccctcgcagggctggcggaggctccgcatcgcctctctcctaggatacagaaaccatggcaacgaaagtagaatgtaaaactcgcagcagatatcagtgggaagggctgggggagggggcacccagctgcctttcctccctcacaggagccaccaccagccacctctcaggagaagccagaggccctggccaaagataggaggaagaaagagaactctccatagaatgtaatttatagatgcgtgtatatgtatatatatctatttatatgtaaataggcatatatgaagatatatatatatatagtctactttttaaactctgcagggatttggttaagttgttgagctgatttcttccatgttttagaaaatgaggcctgtttggggaaggtaccctggtgatgtttttgctagacattagctgtagctgacagcataaggagagtcgcatcagagcttttcacagccccccgaaaccccagcctggttttgatggcagcagtaatcatgatagtgtgaacccgcgaaggcctcaggattatggttaacctggagaggagcaggccatggaggcaggtgccaggtcagtattgagtcacagtagaggccccacaaggacctgcttgggtgagaccacctctcccctctcagcagcgctggtgggctctttgtcctggtgcccaggagccctccagccccctgcccacagaagggaaggcctgcagagggggccaggatctacctaaccatttccccacccctaagtccctcagtgggctttgccttataggtgccacagggcacagctccatcattgccactggtttttcctaagtcatgcaccaaggacttcagaaagttcttcctccgagtcagtcagtggtgccgggaccccagggcagcctcctcgactcctgaagaaaaggcagtgcccgtggctgcctctgtcttcactcgctgttgatgtgaccgccaggcctcctctcgtaccttggacaaaggatacacctgaaccagaatagttttcttaccctcacattgaaatgaggattttgcttaaaacagcacttgccgccagtgggaggagggaggttttatttattcccacagtttctcctgggccttctggaatgaccatgttttcctgtggcggtgggtgtgtcattgcgcccgccgtcttccaaagccttacttccccaagctgccagccaggaggtgataaccaccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggccccggtgctctgcccccacgccccgaccatctggtcttggtagatgtccctagacgggctgagccatgtgcaataagaacatagatcctaaaggatcctctggaagctgtatttcttgaattagaattctcaaattgtacatctgttaatatatgtttattatgtgactggc

SEQ ID NO: 127647 - DNA, 3278 bp, Homo sapiens
  Payload ID: 4982
  Gene Symbol: DNAJB12
  Gene Name: DnaJ (Hsp40) homolog, subfamily B, member 12
  Uniprot ID: Q9NXW2
  ENST ID: ENST00000444643
  CDS Start-End: 334-1461
actccgaaggccccagtctcatcccgacggctaccacgtgaccttcctgagcttgggtttcctcctccggaagattagagggttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaaactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttccctccctcgcagggctggcggaggctccgcatcgcctctctcctaggatacagaaaccatggcaacgaaagtagaatgtaaaactcgcagcagatatcagtgggaagggctgggggagggggcacccagctgcctttcctccctcacaggagccaccaccagccacctctcaggagaagccagaggccctggccaaagataggaggaagaaagagaactctccatagaatgtaatttatagatgcgtgtatatgtatatatatctatttatatgtaaataggcatatatgaagatatatatatatatagtctactttttaaactctgcagggatttggttaagttgttgagctgatttcttccatgttttagaaaatgaggcctgtttggggaaggtaccctggtgatgtttttgctagacattagctgtagctgacagcataaggagagtcgcatcagagcttttcacagccccccgaaaccccagcctggttttgatggcagcagtaatcatgatagtgtgaacccgcgaaggcctcaggattatggttaacctggagaggagcaggccatggaggcaggtgccaggtcagtattgagtcacagtagaggccccacaaggacctgcttgggtgagaccacctctcccctctcagcagcgctggtgggctctttgtcctggtgcccaggagccctccagccccctgcccacagaagggaaggcctgcagagggggccaggatctacctaaccatttccccacccctaagtccctcagtgggctttgccttataggtgccacagggcacagctccatcattgccactggtttttcctaagtcatgcaccaaggacttcagaaagttcttcctccgagtcagtcagtggtgccgggaccccagggcagcctcctcgactcctgaagaaaaggcagtgcccgtggctgcctctgtcttcactcgctgttgatgtgaccgccaggcctcctctcgtaccttggacaaaggatacacctgaaccagaatagttttcttaccctcacattgaaatgaggattttgcttaaaacagcacttgccgccagtgggaggagggaggttttatttattcccacagtttctcctgggccttctggaatgaccatgttttcctgtggcggtgggtgtgtcattgcgcccgccgtcttccaaagccttacttccccaagctgccagccaggaggtgataaccaccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggccccggtgctctgcccccacgccccgaccatctggtcttggtagatgtccctagacgggctgagccatgtgcaataagaacatagatcctaaaggatcctctggaagctgtatttcttgaattagaattctcaaattgtacatctgttaatatatgtttattatgtgactgg

SEQ ID NO: 127648 - DNA, 2369 bp, Homo sapiens
  Payload ID: 4982
  Gene Symbol: DNAJB12
  Gene Name: DnaJ (Hsp40) homolog, subfamily B, member 12
  ENST ID: ENST00000461919
  CDS Start-End: 1344-1862
aaaataaacataactcctttaagggagagaatgggcgctagacagggagacatttctgttcttcgggcgccagggaaaggcgcttccgtatcttcactccctctcacctctcgggctgagggtcagggaccactctcccaaaatgcaagccggcctttgcacccaccccagtccgccgcctcggactgtcctgaagccgggcccctcactcctcccgatgatgagattcggagcgggtggcctggtgggaggtgctgacctcagccaccgccagtcctccatcgcccgcaagagtccagcggcggtcagccatgtggacgccgaggctgctgagttgccctggacaggagcctcctgagccagggagggaagagtgaagctggctttacaactcatcacctcgcttcacccgggaaccctttcttttttctttaacctaagttttccaaggagtttttcttaatccacgctagaggggagagagacaccgggtggtgcttgtgatcaccactcagtaaaccgtctgggaataacaggcactccgaagggcccagtctcatcctgacggctaccacgtgaccttcctgagcttgggtttcctcctcgggaagattagagggttggcgcagataatgtgattggcaataatacccatagggctttgcagtttaggaagctccttcacctgtgccttctcacttgagcctgccagtcagggatgcagagcaaagatcattatctttattctatgggtgaggaaaatctctgaggtaagggatgcccaggatgacacagctagaaagtaaaatgttctgtgactctgtaaatgtttatgaaggaaaagaaatgaaattgaggaacagcagtcagcctcctaaccggccctgcccgcctgatgagattgagaaagcggaacgctggtggaagaggtagcctggactgctgaactttcctccctccggactcttgcaggttgatctttggcctgtttgcctccccttggagagggtttcgggctgtatttgccaggacacctgagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagagactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttccctccctcgcagggctggcggaggctccgcatcgcctctctcctaggatacagaaaccatggcaacgaaagtagaatgtaaaactcgcagcagatatcagtgggaagggctgggggagggggcacccagctgcctttcctccctcacaggagccaccaccagccacctctcaggagaagccagaggccctggccaaagataggaggaagaaagagaactctccatagaatgtaatttatagatgcgtgtatatgtatatatatctatttatatgtaaataggcatatatgaagatatatatatatatagtctactttttaaactctgcagggatttggttaa

SEQ ID NO: 127649 - DNA, 2116 bp, Homo sapiens
  Payload ID: 4982
  Gene Symbol: DNAJB12
  Gene Name: DnaJ (Hsp40) homolog, subfamily B, member 12
  ENST ID: ENST00000463786
  CDS Start-End: 1-829
agctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaagtatgagccagggctgcctccaccctgcaactcctggcagctttggccctggtcatgagcagaggagggagggggagaaagggaggaagcctggtgattgtggcaaagactcctgtccccagcctgacctccagcctccagagaccgagcagctgtggggcctgctgggaaaccaaggtcggtttccgccctctagcgatgctgtcctccccactcctccgctctgctccctggctccaggggtgtgggggaccccagaaccaggcagagtgggaacttgaaactgttgctgagggccacccggggcttcttggtccactccagccatcagtcagcacggccctttctccagcacagcagactattgtccgtgccctggtatttaggccatcacatatggtggggcccaagagagccccatatgcacactgcctgcctgataccaggaagaaccatgtgggaataggtgggccaagagccctcccctttctccatccctccagctaggaggaaatggagcaagatgaacaggcagccacgaggtgggtgggagctggcagtcttggtggcggcaggggccgcgggccctgaccacccccctctggtgggatctgaggcactctctcgaatgccgtcacacctggcagcctggaagccacaggcatccggccttgcccaggcatctcgcctgcggtctgaggaagggaacagaaggtcatgagttcagggtcagacgcagccgctcagcacaggaggggtggaggggaaatgagagttgctggtagcaggctccctccttctgcagcccggcgaatgggggcgctgggctctgttcccagcgtttgccagaggtggccacttcagccaagcccagagaagtgtgggcagaagcagtgaaggttcttctctgtgtgggtgccctgcccaccccctcctttgcctgtgtcctcccggcctggatccatggctgactctgcctggaggccatttgtgcctgcctctgtgctgccgcaggagggcaggccgcaagtggggttggtgggggtcgagcgggcagcacggtgcagcggtgcagtggcaaggggggctacttgtgtggcataagctagaggagccggtgccgcctgaatgccgagctaactgttgccactctcctccccagactatgaaatccctggagaatttttggtgacatgcactgagccaaggtgatggactgtatatttgaggaaagacaaacaaagaaacaaaattaaa

SEQ ID NO: 127650 - DNA, 1875 bp, Homo sapiens
  Payload ID: 4983
  Gene Symbol: DNAJB13
  Gene Name: DnaJ (Hsp40) homolog, subfamily B, member 13
  Uniprot ID: P59910
  ENST ID: ENST00000339764
  CDS Start-End: 752-1702
taatgtaagatgttaataataggggaatgtgaatgcagtggctcacacctgtaatcccagcactttgggaggccaagccgagcccaagagttcaagaccagtctgggcaacatggtgaaaccccatctctacaaaacatacaaaaattagccaggcatggtagtgcacgcctgtgtctcagctacttggaaggctgaggtggaagaatcccttgagcctgggaggttgagactgcagtgaggtgtgatcctgccactgcccaccagcctgggtgacagagtgaagaccctgtctcaaaaacatgataatgataataataataataaaataggagaatgtggatgtgaggtatatgggaactctctgtactgtcttctcaacttttctaaactctaaaactgttctaaaataaatgtatttttaaaaaattagccaaatgcatttcttctaaaacctttttattaaaactaattactgctctctttaaaaacaaaaacaaaataaaacagagccctgtgagtcttcaatttccgagttgagtgacctttcacagggtcgcagaatcagccccagctctcccccagtcctttcactgactcctctctgtggcagagctgaaatttgtttagggaagtgggactacaactcccagagtgcacctgtgcggttgtcaggagcaaccaaggaagccaactaacagccttgctagagtctgaggactatccagggcctgactgccagctagccagccatgggccaggattattactctgtgctcgggatcactcgcaattcagaggatgcccagatcaagcaggcgtaccgcagactcgcccttaagcaccacccgttgaagtcaaatgagccgtcttcagcagagattttcaggcaaatagcagaggcctacgacgtgctgagtgaccccatgaagagaggcatctacgacaagtttggagaagagggcctgaagggtgggattcctttggagtttggatcccagaccccatggacaactggttacgtcttccatggcaaacctgaaaaggtgttccacgagttctttggtggaaacaaccccttcagtgagttttttgatgcagaaggaagtgaggtagatttgaactttggggggctccagggccgaggggtcaagaagcaggacccccaagtcgaacgggatctctacctgtccctggaggacttattctttggctgcaccaaaaaaattaagatctccagaagggtgctgaacgaggatgggtactcctccaccatcaaggacaagatcctgaccattgatgtgaagcccggttggaggcagggcacacgcatcacctttgagaaggaaggggaccagggccccaacatcatcccagcagacatcattttcatcgtaaaggagaagctacaccctcgcttccgcagggagaatgacaacctcttcttcgtgaaccccatccctcttggcaaggctctcacctgctgcactgtggaggtgaggaccctagatgaccgtctgctcaacatccccatcaatgacatcatccaccccaaatacttcaagaaggtgccaggggaggggatgccattgccggaggaccccactaagaaaggggatctcttcatcttcttcgacatccagttccccacccgcctcacaccccagaagaagcagatgctgcgccaggcattgctgacatgactgtggtgggctggagcaggggtgagaggaggctagccgggcctcaccccacccctacccgccacagcctcagggtgtgcaggggagcctgctgcacagatatgatacaagggtgggatggcgcagggcttaaactgacataataaagatctatttcctgtcctccagctaca

SEQ ID NO: 127651 - DNA, 1779 bp, Homo sapiens
  Payload ID: 4983
  Gene Symbol: DNAJB13
  Gene Name: DnaJ (Hsp40) homolog, subfamily B, member 13
  Uniprot ID: P59910
  ENST ID: ENST00000543947
  CDS Start-End: 1249-1674
agtgcaggagtgccctctgcagccttcccaactgggacaggctctttcccttcctttctttcagttcagccccatccccgtgggaactggaaaggctctgaatgggaggagtctcttctgaattcttccttctgggctttaccagaccatattcccaggatttcatcagggtgcatgcctcgtgcataagaaagaacagtgggcatggagggtgggctgggagatagtccccaaggtgacgggttgaggaagaccctcagtgcctcatgtctagtccttggcttggccctgtcccatggcccagccctgtgccaggcataagagcaagccccctccacctttgcccagcagaggagatgccgatgcggccatgctttccacagatggaacccatctggacatgcgactggggagtggaaggatccccagtggggaatgcactgggggaggcttagatatgttgactttcatttctctctttgggattaagagacttgctggaggctcagggccgggcctctgggatttggagagaggaatggagtacattttcaccatgtatctgttagtggccagggctggagctgtgtgtttgatcaactaatggtgactgcttggcatctcagcccccagccccagtctcatggcatcctctgccatactggaatcataagttcttggttgtcatggcaacaggatgggagtgggagtggctcagggcaggctctccccattgctggaggctcttcccattgctagaggattgagcccaagtacaaatcccatagagcatctttcacgtgtgcaaaggtcacctgagtgttcatgaaaatctgagcaaatctcgactgtactcatggaagtcctaagcagacctccccacacctgatatgttgctataggtgctgaacgaggatgggtactcctccaccatcaaggacaagatcctgaccattgatgtgaagcccggttggaggcagggcacacgcatcacctttgagaaggaaggggaccagcgcccagaagagacctcagcagagttttggtgacttaatgaagtttgggacaggggtgtcatgcctggagttactagcaagacagagacatacgggcagttgcctgacgcccagcttagtgttccacctgcctgccgtctgaggaagcctctccgcccctccagctgagtgtgtctattttgggcatgctcagtacagaagtaattctggggggattcatttggatgaagacatggagacaagtagaggcaggaacttggccaaggtcacacggccaactagtccttgtcaccttttggcgtcccctgcccagggccccaacatcatcccagcagacatcattttcatcgtaaaggagaagctacaccctcgcttccgcagggagaatgacaacctcttcttcgtgaaccccatccctcttggcaaggctctcacctgctgcactgtggaggtgaggaccctagatgaccgtctgctcaacatccccatcaatgacatcatccaccccaaatacttcaagaaggtgccaggggaggggatgccattgccggaggaccccactaagaaaggggatctcttcatcttcttcgacatccagttccccacccgcctcacaccccagaagaagcagatgctgcgccaggcattgctgacatgactgtggtgggctggagcagggctacacccacgagagtacattggagaggagcttcatattagcccttcttgtggggcacagggaagaaagaggcctaaggagctg

SEQ ID NO: 127652 - DNA, 912 bp, Homo sapiens
  Payload ID: 4983
  Gene Symbol: DNAJB13
  Gene Name: DnaJ (Hsp40) homolog, subfamily B, member 13
  Uniprot ID: P59910
  ENST ID: ENST00000537753
  CDS Start-End: 371-796
tctgggtctctggatacaatttctcttactcctctccctacctcctgcagagttttttgatgcagaaggaagtgaggtagatttgaactttggggggctccagggccgaggggtcaagaagcaggacccccaagtcgaacgggatctctacctgtccctggaggacttattctttggctgcaccaaaaaaattaagatctccagaagggtgctgaacgaggatgggtactcctccaccatcaaggacaagatcctgaccattgatgtgaagcccggttggaggcagggcacacgcatcacctttgagaaggaaggggaccaggcccttccagaaaacctgctctcatctccccattgtacagatgaagacatggagacaagtagaggcaggaacttggccaaggtcacacggccaactagtccttgtcaccttttggcgtcccctgcccagggccccaacatcatcccagcagacatcattttcatcgtaaaggagaagctacaccctcgcttccgcagggagaatgacaacctcttcttcgtgaaccccatccctcttggcaaggctctcacctgctgcactgtggaggtgaggaccctagatgaccgtctgctcaacatccccatcaatgacatcatccaccccaaatacttcaagaaggtgccaggggaggggatgccattgccggaggaccccactaagaaaggggatctcttcatcttcttcgacatccagttccccacccgcctcacaccccagaagaagcagatgctgcgccaggcattgctgacatgactgtggtgggctggagcaggggtgagaggaggctagccgggcctcaccccacccctacccgccacagcctcagggtgtgcaggggagcctgctgcacagatatgatacaagggtgg

SEQ ID NO: 127653 - DNA, 776 bp, Homo sapiens
  Payload ID: 4983
  Gene Symbol: DNAJB13
  Gene Name: DnaJ (Hsp40) homolog, subfamily B, member 13
  ENST ID: ENST00000542350
  CDS Start-End: 1-652
acaatttctcttactcctctccctacctcctgcagagttttttgatgcagaaggaagtgaggtagatttgaactttggggggctccagggccgaggggtcaagaagcaggacccccaagtcgaacgggatctctacctgtccctggaggacttattctttggctgcaccaaaaaaattaagatctccagaagggtgctgaacgaggatgggtactcctccaccatcaaggacaagatcctgaccattgatgtgaagcccggttggaggcagggcacacgcatcacctttgagaaggaaggggaccagggccccaacatcatcccagcagacatcattttcatcgtaaaggagaagctacaccctcgcttccgcagggagaatgacaacctcttcttcgtgaaccccatccctcttggcaaggctctcacctgctgcactgtggaggtgaggaccctagatgaccgtctgctcaacatccccatcaatgacatcatccaccccaaatacttcaagaaggtgccaggggaggggatgccattgccggaggaccccactaagaaaggggatctcttcatcttcttcgacatccagttccccacccgcctcacaccccagaagaagcagatgctgcgccaggcattgctgacatgactgtggtgggctggagcaggggtgagaggaggctagccgggcctcaccccacccctacccgccacagcctcagggtgtgcaggggagcctgctgcacagatatgatacaagggtgggatggcgc

SEQ ID NO: 127654 - DNA, 2617 bp, Homo sapiens
  Payload ID: 4984
  Gene Symbol: DNAJB14
  Gene Name: DnaJ (Hsp40) homolog, subfamily B, member 14
  ENST ID: ENST00000334223
  CDS Start-End: 18-155
ggaagaaggagcaagctatggaggggaacagggatgaggctgagaaatgtgtcgagatcgcccgggaggccctgaacgccggcaaccgcgagaaggcccagcgcttcctgcagaaggccgagaagctctacccactgccctcggcccgcgcataaacaaatgtaaaaattactatgaagtacttggagttacgaaagatgctggtgatgaagatttgaaaaaagcttatagaaagcttgctttgaagtttcatccagacaaaaaccatgcacctggagcaacagatgcttttaaaaagattggaaatgcttatgctgttttaagtaatccagaaaagcgaaaacagtatgacctcacgggcaatgaagaacaagcatgtaaccaccaaaacaatggcagatttaatttccatagaggttgtgaagctgatataactccagaagacttgtttaatatattttttgggggtggatttccttcaggtagtgtacattctttttcaaatggaagagctggttatagccaacaacatcagcatcgacatagtggacatgaaagagaagaggaaagaggagatggaggtttttctgtgtttatccagctgatgcccataattgtattgatcctcgtgtcattattaagccagttgatggtctctaatcctccttattccttatatcccagatctggaactgggcaaactattaaaatgcaaacagaaaacttgggtgttgtttattatgtcaacaaggacttcaaaaatgaatataaaggaatgttattacaaaaggtagaaaagagtgtggaggaagattatgtgactaatattcgaaataactgctggaaagaaagacaacaaaaaacagatatgcagtatgcagcaaaagtataccgtgatgatcgactccgaaggaaggcagatgccttgagcatggacaactgtaaagaattagagcggcttaccagtctttataaaggaggatgaactggaatttttatttataccttttagcgtactctttattttttctgtaagtaagtttggtttcatcatgagggatgaaggaaaagatttgatactgaaaactaaactgaatagttggttcctgaaatcttggactgtttatgacctactggctcctttaaatagtaactgaaaactaaaatggaatattttagttaacgcttctacaagtattttcattttaaaagcttacatgattcctaactaaagtgtcatgagaaaggattatcacacctgtagcaatttccagttttagtgattctccattttttcccttgtcatgtaaatatttatggaatgatcattttgtgtacatacaggttactgcttttttatttaaattcttttagtgtttagctccatgagacacttcagtttaaattgatggaataaatgttatatgacacatttacattttccttatcaaggtgtcaaatatgtggactttaaacaatgaaactttttcaaaaagaaaaaacaaaaactttaactttgtgtaaaatcttatagtattatcagcttagagggaattgatatttttaatattgccgttatattccaaaatatatattgagataaatgaactggtgtagaatatcagtttgctatttagttttatgaattactatacatatacatgcatagaaatgaaatgctatactgataaattttaaagaaaatatgaggaaatggctataaatattaaactaaaagggtcttcaacagtaaagtgcagttatgtcatttaaaattccaatactttaaaggccaccaaattttgatgtatatgtccttgaagggctgctaaaatttatgaagaggactcacattttcccccatagaaatttgcagtttcttggtgatcatttaagcaggatccaaagaagttcctttacaaataagtaataagaaaaatgagtactaaaatacagctttgtgccttttaaccctatgccaactcctaaacatataagtagattacagtatacttatctgatcagagcatgatctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaaacagctggaaattgaagtttttgatgcctgtatactggatatgaaactatttgatttctagtcttctgtgtttagcagttgtaatattttaatgattttgcttcatactcggttaatggaacataaacatatctttgatacttctttgtgagtgagagaatgctagatagggtggctttgttctttgtttaagttttttttcctgaatgtagttaatttatggcatctgttgaataaaactgctaaaatgacctcttaaaaatgttctgttgtatccccttttccaggtgaatcaatagaaatgcctgattgaattagtaggttaaactaaacaacatactgtcataggaaaactggagagcttaaccaacttgctcttagaaatgttaccttaaaaaaaaaaaaaaa

SEQ ID NO: 127655 - DNA, 998 bp, Homo sapiens
  Payload ID: 4984
  Gene Symbol: DNAJB14
  Gene Name: DnaJ (Hsp40) homolog, subfamily B, member 14
  ENST ID: ENST00000455208
  CDS Start-End: 1-126
ttttcaaatggaagagctggttatagccaacaacatcagcatcgacatagtggacatgaaagagaagaggaaagaggagatcaatttaattacatgaagtggaaaggtaaatggaaagagcactagactagaaattaaaaggcctggcccccagctttgccactcatcagctcccatcttctaccctcaaatccaagggaggtttttctgtgtttatccagctgatgcccataattgtattgatcctcgtgtcattattaagccagttgatggtctctaatcctccttattccttatatcccagatctggaactgggcaaactattaaaatgcaaacagaaaacttgggtgttgtttattatgtcaacaaggacttcaaaaatgaatataaaggaatgttattacaaaaggtagaaaagagtgtggaggaagattatgtgactaatattcgaaataactgctggaaagaaagacaacaaaaaacagatatgcagtatgcagcaaaagtataccgtgatgatcgactccgaaggaaggcagatgccttgagcatggacaactgtaaagaattagagcggcttaccagtctttataaaggaggatgaactggaatttttatttataccttttagcgtactctttattttttctgtaagtaagtttggtttcatcatgagggatgaaggaaaagatttgatactgaaaactaaactgaatagttggttcctgaaatcttggactgtttatgacctactggctcctttaaatagtaactgaaaactaaaatggaatattttagttaacgcttctacaagtattttcattttaaaagcttacatgattcctaactaaagtgtcatgagaaaggattatcacacctgtagcaatttccagttttagtgattctccattttttcccttgtcatgtaaatatttatggaatgatcattttgtgtacatacaggttactgcttttttatttaaattcttttagtgtt

SEQ ID NO: 127656 - DNA, 662 bp, Homo sapiens
  Payload ID: 4984
  Gene Symbol: DNAJB14
  Gene Name: DnaJ (Hsp40) homolog, subfamily B, member 14
  ENST ID: ENST00000426476
  CDS Start-End: 1-317
gggatgaggctgagaaatgtgtcgagatcgcccgggaggccctgaacgccggcaaccgcgagaaggcccagcgcttcctgcagaaggccgagaagctctacccactgccctcggcccgcgcactattggaaataattatgaaaaatggaagcacggctggaaatagccctcattgccgaaaaccatcaggtagtggcgatcaaagcaagcctaattgcacaaaggacagcacatctggtagtggtgaaggtggaaaaggctataccaaagaccaagtagatggagttctcagagctttatggatattggaacattgatatgggatggtggacctgtacctaacacacacataaacaaatgtaaaaattactatgaagtacttggagttacgaaagatgctggtgatgaagatttgaaaaaagcttatagaaagcttgctttgaagtttcatccagacaaaaaccatgcacctggagcaacagatgcttttaaaaagattggaaatgcttatgctgttttaagtaatccagaaaagcgaaaacagtatgacctcacgggcaatgaagaacaagcatgtaaccaccaaaacaatggcagatttaatttccatagaggttgtgaagctgatataactccagaagacttgtttaatatattttttg

SEQ ID NO: 127657 - DNA, 842 bp, Homo sapiens
  Payload ID: 4984
  Gene Symbol: DNAJB14
  Gene Name: DnaJ (Hsp40) homolog, subfamily B, member 14
  ENST ID: ENST00000398991
  CDS Start-End: 25-162
aggaaacggaagaaggagcaagctatggaggggaacagggatgaggctgagaaatgtgtcgagatcgcccgggaggccctgaacgccggcaaccgcgagaaggcccagcgcttcctgcagaaggccgagaagctctacccactgccctcggcccgcgcataaacaaatgtaaaaattactatgaagtacttggagttacgaaagatgctggtgatgaagatttgaaaaaagcttatagaaagcttgctttgaagtttcatccagacaaaaaccatgcacctggagcaacagatgcttttaaaagtatgagttaataccttgatgttgtttagattggaaatgcttatgctgttttaagtaatccagaaaagcgaaaacagtatgacctcacgggcaatgaagaacaagcatgtaaccaccaaaacaatggcagatttaatttccatagaggttgtgaagctgatataactccagaagacttgtttaatatattttttgggggtggatttccttcaggtagtgtacattctttttcaaatggaagagctggttatagccaacaacatcagcatcgacatagtggacatgaaagagaagaggaaagaggagatggaggtttttctgtgtttatccagctgatgcccataattgtattgatcctcgtgtcattattaagccagttgatggtctctaatcctccttattccttatatcccagatctggaactgggcaaactattaaaatgcaaacagaaaacttgggtgttgtttattatgtcaacaaggacttcaaaaatgaatataaaggaatgttattacaaaaggtagaaaagagtgtggag

SEQ ID NO: 127658 - DNA, 6075 bp, Homo sapiens
  Payload ID: 4984
  Gene Symbol: DNAJB14
  Gene Name: DnaJ (Hsp40) homolog, subfamily B, member 14
  Uniprot ID: Q8TBM8
  ENST ID: ENST00000442697
  CDS Start-End: 156-1295
gtccgcccgggccgtcgcagccgctgccgcggtcccctgcgctcctccccgctgccgccgcacgcccccagccggtcccgcctcgcctcctccgcggcggcggcttccgcccttcttagctgcgctgccggaggaaacggaagaaggagcaagctatggaggggaacagggatgaggctgagaaatgtgtcgagatcgcccgggaggccctgaacgccggcaaccgcgagaaggcccagcgcttcctgcagaaggccgagaagctctacccactgccctcggcccgcgcactattggaaataattatgaaaaatggaagcacggctggaaatagccctcattgccgaaaaccatcaggtagtggcgatcaaagcaagcctaattgcacaaaggacagcacatctggtagtggtgaaggtggaaaaggctataccaaagaccaagtagatggagttctcagcataaacaaatgtaaaaattactatgaagtacttggagttacgaaagatgctggtgatgaagatttgaaaaaagcttatagaaagcttgctttgaagtttcatccagacaaaaaccatgcacctggagcaacagatgcttttaaaaagattggaaatgcttatgctgttttaagtaatccagaaaagcgaaaacagtatgacctcacgggcaatgaagaacaagcatgtaaccaccaaaacaatggcagatttaatttccatagaggttgtgaagctgatataactccagaagacttgtttaatatattttttgggggtggatttccttcaggtagtgtacattctttttcaaatggaagagctggttatagccaacaacatcagcatcgacatagtggacatgaaagagaagaggaaagaggagatggaggtttttctgtgtttatccagctgatgcccataattgtattgatcctcgtgtcattattaagccagttgatggtctctaatcctccttattccttatatcccagatctggaactgggcaaactattaaaatgcaaacagaaaacttgggtgttgtttattatgtcaacaaggacttcaaaaatgaatataaaggaatgttattacaaaaggtagaaaagagtgtggaggaagattatgtgactaatattcgaaataactgctggaaagaaagacaacaaaaaacagatatgcagtatgcagcaaaagtataccgtgatgatcgactccgaaggaaggcagatgccttgagcatggacaactgtaaagaattagagcggcttaccagtctttataaaggaggatgaactggaatttttatttataccttttagcgtactctttattttttctgtaagtaagtttggtttcatcatgagggatgaaggaaaagatttgatactgaaaactaaactgaatagttggttcctgaaatcttggactgtttatgacctactggctcctttaaatagtaactgaaaactaaaatggaatattttagttaacgcttctacaagtattttcattttaaaagcttacatgattcctaactaaagtgtcatgagaaaggattatcacacctgtagcaatttccagttttagtgattctccattttttcccttgtcatgtaaatatttatggaatgatcattttgtgtacatacaggttactgcttttttatttaaattcttttagtgtttagctccatgagacacttcagtttaaattgatggaataaatgttatatgacacatttacattttccttatcaaggtgtcaaatatgtggactttaaacaatgaaactttttcaaaaagaaaaaacaaaaactttaactttgtgtaaaatcttatagtattatcagcttagagggaattgatatttttaatattgccgttatattccaaaatatatattgagataaatgaactggtgtagaatatcagtttgctatttagttttatgaattactatacatatacatgcatagaaatgaaatgctatactgataaattttaaagaaaatatgaggaaatggctataaatattaaactaaaagggtcttcaacagtaaagtgcagttatgtcatttaaaattccaatactttaaaggccaccaaattttgatgtatatgtccttgaagggctgctaaaatttatgaagaggactcacattttcccccatagaaatttgcagtttcttggtgatcatttaagcaggatccaaagaagttcctttacaaataagtaataagaaaaatgagtactaaaatacagctttgtgccttttaaccctatgccaactcctaaacatataagtagattacagtatacttatctgatcagagcatgatctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaaacagctggaaattgaagtttttgatgcctgtatactggatatgaaactatttgatttctagtcttctgtgtttagcagttgtaatattttaatgattttgcttcatactcggttaatggaacataaacatatctttgatacttctttgtgagtgagagaatgctagatagggtggctttgttctttgtttaagttttttttcctgaatgtagttaatttatggcatctgttgaataaaactgctaaaatgacctcttaaaaatgttctgttgtatccccttttccaggtgaatcaatagaaatgcctgattgaattagtaggttaaactaaacaacatactgtcataggaaaactggagagcttaaccaacttgctcttagaaatgttaccttaaaaaaaaaaaaaaagcagtgcttaagagaaaatacaattttaattattttgttgagcctgcagagtaagtttttaaaaatataagttcatagcattttaattaactttgaaagttcatatgcatcagaaaatttatgaaaatttgaatgaaaaaaatttcatctatttatttttctaattttaatggcaaatttacactattatggctgataattctgtgaacttaccttcttgttgactgattctttttcccttaatcccagctttaaggagataggtgaagttattgtacaaagttaagtgataccataaagtatatattataaagtcatacatggcttttggacagtattatatttcagttgcagtgctgcattccattaaatttcataaaatgctagggaaaatgtgtttgataaaattttctgcagtgagaaatgacagactgagtgcctgacaatttaagccacatatgaagtatgcaagtaaagattcagtccttaatgtcatctatatcatggtataaaagctcaacaagtatcttataatttggagttaactttataaagtaagaagagtttggatatcttgataaaagattttcatgtttgctgctttttttataataaaaatcccaacattttgccatcttatgtttagctacatgaacttcgcaatttcatcggctcattctaatgaccacctaaaagtcctcaatctttgaatattgctttattagctcctctaactggtattctaacagtttagcagcacttatatttattaatgctttacatttttacccctttttgtgtaaacacaaatacacccatgcatatacacacaaacattattgtccttgtgagggtttgggggaaatgaaaaatagtacctttctcctcttcttttgattccttagttcccaaatagactggtgctagtcatttagtcatctgtaaatttcgaaatgtagtttgattaaatgtgaactgaattctcagcaatgaaaaatgtcaagttgaattcatctaataagtgaaaataatatattttgtaaacagattacatttgaacacctaaataagtatttgtttcataatcattacatgcttgtttatgatttacaaagatttggtagagaaaagtacagtccttaaggcatatatatgccaatgcattaaactactcagcttttgtgccagctcaggtgttcataggaacaggaatgtggaataccagctttttactttaattatacttttatgctgaatttttcttccagttaaacctttaattacactagtatgtaaagtagttactgagaaaaataagtttttgatttcccttctgttgatctgtaacatttttaaatgaagctatttaacacatgacatgctaatgttacttaatggattcctatgtatttcattaaaaaaaagtctcccacctgtgttaagacagctaaatatttcttgatgttggcttgaggaccaagtgagccatcttgccagttaagcaagttttatatcagaggaccaaatggttaagaagagaatttgtacatttcttgagcttccccatgtgaagcttgggttcagtactatcctattactatccatcttcataatgagtgaagcaaactgaaagggaattcataatcttttttcttatctgaacagaaaaactaatgaaaatcaacaataaatctttattttaattttcattcaacagctgaaaaaccatgtctgttgaccacattggaccattgcctagttaaaatccataaaattccctataaaccaatgaaaagaaacttgtctggcaataatttccaacattttaaattctaatttttagttacaaagaaaaaggatagaatgaggcttttcaaggaattcttgctcatcccttcaattatttggcaggtaaaacagtcctagaattcagcttcctttttggttttattactattaaatagatactttcatataaatggaaacacttttcctcaaaacattaattcaaaacatactccttatattaaggattatagcaccatattttttgtatattccctatgtgtaactttttcctgttggtatgtgatatttttcatttaatatgactatctgctggtgttggggccaatagatttgtgaatattctgtggatgtgtctatgtataggtgtatatatatatatatatatttttttttttttttcccagctaattacctcaaatgtgtgattgtttaatatataccacactatgtttgcacagagcagggcttccattagcagtggatatttttatgtctgactttgaaaatcagtcaacacaatttcattggtgtgaattatttgttgctctttttcatattttaatggagagattcctattataaggcccatgcttcaaacataattatatctttctatatccagccatctggaaatacataggggtaagaagtatttcttgaaatgtccttgtttagtaagttagtaaaaactgggatgactagttgccaagatgtcttgtaactgcatagcagatgacacctggcatggcaagtctcattcacttcagcacaacactctgtacatttcagtctgatattctactttgccatttaaggacaccattaaaatcatagagattttcagtgacattggagtattgtaattattactttcaaaaaattatttttaataggatgattaaaccaatgagaagaaacacacataaatgatattttgcagtttatctgtattaagaaatgcttcttgccaatttctagttttagtttttggattgctacataagactttctttccatttactttatgtgtttttaaaagctgcaggtaatttttaaggtttgatggaattataatggaagccttgtataagttaaatgaaattggtaaaggagagcttactttgtctataatgcattcaggattaaaaattagatttcaaaatgaaatgtctgatttgtaaaatatttaatgttatatcagacttacataaaattttctgtgagaactcaaatgcatttgatttttaatgaatgttctgaatgaaatatgaatttttgtctttcagtctctgtagtttatctcaatatattaataaaaaggtctgttctcactgtaaaa

SEQ ID NO: 127659 - DNA, 3442 bp, Homo sapiens
  Payload ID: 4984
  Gene Symbol: DNAJB14
  Gene Name: DnaJ (Hsp40) homolog, subfamily B, member 14
  ENST ID: ENST00000420137
  CDS Start-End: 1-146
agcctaattgcacaaaggacagcacatctggtagtggtgaaggtggaaaaggctataccaaagaccaagtagatggagttctcagccttgaaagaaaaagaagagtagtccaaggtgtggtagaaataaggaaggaagagcattgatgcctctttgttctggggatttttctgaagaaagccatgttatcttgttggttagcacgattatgcaaacaagttgctcagtgacaatttggctcaatggggagaagtcttgcaataatactgcatccattgcataaagctttatggatattggaacattgatatgggatggtggacctgtacctaacacacacataaacaaatgtaaaaattactatgaagtacttggagttacgaaagatgctggtgatgaagatttgaaaaaagcttatagaaagcttgctttgaagtttcatccagacaaaaaccatgcacctggagcaacagatgcttttaaaaagattggaaatgcttatgctgttttaagtaatccagaaaagcgaaaacagtatgacctcacgggcaatgaagaacaagcatgtaaccaccaaaacaatggcagatttaatttccatagaggttgtgaagctgatataactccagaagacttgtttaatatattttttgggggtggatttccttcaggtagtgtacattctttttcaaatggaagagctggttatagccaacaacatcagcatcgacatagtggacatgaaagagaagaggaaagaggagatggaggtttttctgtgtttatccagctgatgcccataattgtattgatcctcgtgtcattattaagccagttgatggtctctaatcctccttattccttatatcccagatctggaactgggcaaactattaaaatgcaaacagaaaacttgggtgttgtttattatgtcaacaaggacttcaaaaatgaatataaaggaatgttattacaaaaggtagaaaagagtgtggaggaagattatgtgactaatattcgaaataactgctggaaagaaagacaacaaaaaacagatatgcagtatgcagcaaaagtataccgtgatgatcgactccgaaggaaggcagatgccttgagcatggacaactgtaaagaattagagcggcttaccagtctttataaaggaggatgaactggaatttttatttataccttttagcgtactctttattttttctgtaagtaagtttggtttcatcatgagggatgaaggaaaagatttgatactgaaaactaaactgaatagttggttcctgaaatcttggactgtttatgacctactggctcctttaaatagtaactgaaaactaaaatggaatattttagttaacgcttctacaagtattttcattttaaaagcttacatgattcctaactaaagtgtcatgagaaaggattatcacacctgtagcaatttccagttttagtgattctccattttttcccttgtcatgtaaatatttatggaatgatcattttgtgtacatacaggttactgcttttttatttaaattcttttagtgtttagctccatgagacacttcagtttaaattgatggaataaatgttatatgacacatttacattttccttatcaaggtgtcaaatatgtggactttaaacaatgaaactttttcaaaaagaaaaaacaaaaactttaactttgtgtaaaatcttatagtattatcagcttagagggaattgatatttttaatattgccgttatattccaaaatatatattgagataaatgaactggtgtagaatatcagtttgctatttagttttatgaattactatacatatacatgcatagaaatgaaatgctatactgataaattttaaagaaaatatgaggaaatggctataaatattaaactaaaagggtcttcaacagtaaagtgcagttatgtcatttaaaattccaatactttaaaggccaccaaattttgatgtatatgtccttgaagggctgctaaaatttatgaagaggactcacattttcccccatagaaatttgcagtttcttggtgatcatttaagcaggatccaaagaagttcctttacaaataagtaataagaaaaatgagtactaaaatacagctttgtgccttttaaccctatgccaactcctaaacatataagtagattacagtatacttatctgatcagagcatgatctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaaacagctggaaattgaagtttttgatgcctgtatactggatatgaaactatttgatttctagtcttctgtgtttagcagttgtaatattttaatgattttgcttcatactcggttaatggaacataaacatatctttgatacttctttgtgagtgagagaatgctagatagggtggctttgttctttgtttaagttttttttcctgaatgtagttaatttatggcatctgttgaataaaactgctaaaatgacctcttaaaaatgttctgttgtatccccttttccaggtgaatcaatagaaatgcctgattgaattagtaggttaaactaaacaacatactgtcataggaaaactggagagcttaaccaacttgctcttagaaatgttaccttaaaaaaaaaaaaaaagcagtgcttaagagaaaatacaattttaattattttgttgagcctgcagagtaagtttttaaaaatataagttcatagcattttaattaactttgaaagttcatatgcatcagaaaatttatgaaaatttgaatgaaaaaaatttcatctatttatttttctaattttaatggcaaatttacactattatggctgataattctgtgaacttaccttcttgttgactgattctttttcccttaatcccagctttaaggagataggtgaagttattgtacaaagttaagtgataccataaagtatatattataaagtcatacatggcttttggacagtattatatttcagttgcagtgctgcattccattaaatttcataaaatgctagggaaaatgtgtttgataaaattttctgcagtgagaaatgacagactgagtgcctgacaatttaagccacatatgaagtatgcaagtaaagattcagtccttaatgtcatctatatcatggtataaaagctcaacaagtatcttataatttggagttaactttataaagtaagaagagtttggatatcttgataaaagattttcatgtttgctgctttttttataataaaaatcccaacattttgccatc

SEQ ID NO: 127660 - DNA, 339 bp, Homo sapiens
  Payload ID: 4984
  Gene Symbol: DNAJB14
  Gene Name: DnaJ (Hsp40) homolog, subfamily B, member 14
  ENST ID: ENST00000610281
  CDS Start-End: 10-339
gagcaagctatggaggggaacagggatgaggctgagaaatgtgtcgagatcgcccgggaggccctgaacgccggcaaccgcgagaaggcccagcgcttcctgcagaaggccgagaagctctacccactgccctcggcccgcgcactattggaaataattatgaaaaatggaagcacggctggaaatagccctcattgccgaaaaccatcaggtagtggcgatcaaagcaagcctaattgcacaaaggacagcacatctggtagtggtgaaggtggaaaaggctataccaaagaccaagtagatggagttctcagagctttatggatattggaacattga

SEQ ID NO: 127661 - DNA, 3176 bp, Homo sapiens
  Payload ID: 4985
  Gene Symbol: DNAJB2
  Gene Name: DnaJ (Hsp40) homolog, subfamily B, member 2
  Uniprot ID: P25686
  ENST ID: ENST00000336576
  CDS Start-End: 289-1263
gtgtgcccaaaatagccggctccgccctcttctcccggcagcccctgcaggcccccacccccccaggggacaggcggagccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcaggtgggcgggaggcacagcaccgacggcaggggcggcccaaggcccagcaccaagatccaggcttgggggggacccaggagggtgcgaggggtgaagcaaccaaacgcagtccatccccagaggagaaggcctctcgctgcctcatcctctgaacaccgggcccaacctgatctgatccagatcttgactggggggtctgactcactgtgggaagagaagaggggagtatcctgagttgtaggaactgctttccaactccaagctccctccacaagtttccctcccaggccccccacaccccagtgtggacttgggatttgctgtgctcagcccagggctgataggtccctggtgaagcccagggtggggggtgtcagggcagtggaggggcccgaggagccaggttgcatttattggatggggagctccaaggggcattagtggtttgggctgggccttttgtgccctggtactctgccacctgtgttgctgatggtgtcaaggaaggaggacttggcctagggttgtctgagccggagccggcagctccactggagagcagtgcaggcagagtggagcctcctgctctcctggaccagctgcagacccccaaccctggtttctgtgccatgttgcgctctgaccgtctctgttgcttctcttctggtgttgcttctcctccctcccattctctctgcaactccctgcgggccgcatcgcttgctttcactgccgtctggctaggactcccttcttccttccttccccgagaaggcctcaatgtggcgaggaagatgctggggccggtagggctgtgagatcttctggggaggctagccgggtggggcgggagcctctcagctgtccagattcagaactggagcccactcctcctccctctcgttgcctcagcctgccctcaccctcaggactaggcagaggtgaggctggctcaccctgaagaggtgggataggaccgggggaccccagagggaggcctaggaggggactgcacccatactgcttccctaccacaaatcagggctcagggagaggccatgcggccagcccaggtctgcatgctgagccccatcctccacagcttgccgctgacgctctctcctgtcaccccgcccctgctctctccccagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttg

SEQ ID NO: 127662 - DNA, 1946 bp, Homo sapiens
  Payload ID: 4985
  Gene Symbol: DNAJB2
  Gene Name: DnaJ (Hsp40) homolog, subfamily B, member 2
  Uniprot ID: P25686
  ENST ID: ENST00000392086
  CDS Start-End: 212-1045
agccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagct

SEQ ID NO: 127663 - DNA, 823 bp, Homo sapiens
  Payload ID: 4985
  Gene Symbol: DNAJB2
  Gene Name: DnaJ (Hsp40) homolog, subfamily B, member 2
  ENST ID: ENST00000392087
  CDS Start-End: 91-823
cggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcaggtg

SEQ ID NO: 127664 - DNA, 652 bp, Homo sapiens
  Payload ID: 4985
  Gene Symbol: DNAJB2
  Gene Name: DnaJ (Hsp40) homolog, subfamily B, member 2
  ENST ID: ENST00000439026
  CDS Start-End: 208-652
aggtgcggccgggggcccgggtcaggctgggggccctggatcggactgctggagttggggggccccgatagggctcctgggcctgggcgtcgagatagctcttggccccggcctgcgggggcagataaggctgccggagggagcctagtcaccggccgcaagcagagcccgccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccg

SEQ ID NO: 127665 - DNA, 686 bp, Homo sapiens
  Payload ID: 4985
  Gene Symbol: DNAJB2
  Gene Name: DnaJ (Hsp40) homolog, subfamily B, member 2
  ENST ID: ENST00000442681
  CDS Start-End: 319-686
gaggtgcggccgggggcccgggtcaggctgggggccctggatcggactgctggagttggggggccccgatagggctcctgggcctgggcgtcgagatagctcttggccccggcctgcgggggcagataaggctgccggagggagcctagtcaccggccgcaagcagagcccggtgtgctccgcttccaactgggagcgccttccgccacccggggagggggactgctgcagccacagggtggggctcttggttctttccgcctgactccttctcttctgcagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggcccctt

SEQ ID NO: 127666 - DNA, 585 bp, Homo sapiens
  Payload ID: 4985
  Gene Symbol: DNAJB2
  Gene Name: DnaJ (Hsp40) homolog, subfamily B, member 2
  ENST ID: ENST00000421532
  CDS Start-End: 190-585
agtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttggtgagtggactctggaagcctctgaatggctcaacttccccctc

SEQ ID NO: 127667 - DNA, 828 bp, Homo sapiens
  Payload ID: 4985
  Gene Symbol: DNAJB2
  Gene Name: DnaJ (Hsp40) homolog, subfamily B, member 2
  ENST ID: ENST00000425450
  CDS Start-End: 145-828
ggagccggccttctccccgtctctagtagtttccgcaccgctgacgcatgcctgcgcgcacagctgggccgggcgcgtcctacgcagcagccgcgagccgggctgcggccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcact

SEQ ID NO: 127668 - DNA, 2988 bp, Homo sapiens
  Payload ID: 4986
  Gene Symbol: DNAJB4
  Gene Name: DnaJ (Hsp40) homolog, subfamily B, member 4
  Uniprot ID: Q9UDY4
  ENST ID: ENST00000370763
  CDS Start-End: 258-1271
agagacacgtagtgaaaatgggaggatctagaaggaggctgtctcctgtgtagtgtatatttatctgtaagtgagccgttggggaaggattgaatacagagacgctgtctgcttgctgccttaagacagctagctgaattgctgattaacttttaaaatacccagcttggtttatttttcttagaatctgttgctaagactggggacgctgttttcttttacaaagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaagggttgaaaggaggagcaggaggtactgatggacaaggaggtaccttccggtacacctttcatggcgatcctcatgctacatttgctgcatttttcggagggtccaacccctttgaaattttctttggaagacgaatgggtggtggtagagattctgaagaaatggaaatagatggtgatccttttagtgcctttggtttcagcatgaatggatatccaagagacaggaattctgtggggccatcccgcctcaaacaagatcctccagttattcatgaacttagagtatcacttgaagagatatatagtggttgtaccaaacggatgaagatttctcgaaaaaggctaaacgctgatggaaggagttacagatctgaggacaaaattcttaccattgagattaaaaaagggtggaaagaaggcaccaaaattacttttccaagagaaggagatgaaacaccaaatagtattccagcagacattgtttttatcattaaagacaaagatcatccaaaatttaaaagggatggatcaaatataatttatactgctaaaattagtttacgagaggcattgtgtggctgctcaattaatgtaccaacactggatggaagaaacatacctatgtcagtaaatgatattgtgaaacccggaatgaggagaagaattattggatatgggctgccatttccaaaaaatcctgaccaacgtggtgaccttctaatagaatttgaggtgtccttcccagatactatatcttcttcatccaaagaagtacttaggaaacatcttcctgcctcatagaatgaagaactttgttacacatattttgataaggcactgaaaatataaaaggactggtagtttactgatgtagatgtgaattctgtataaagatgtgtaaattcttttgagggttcattaaattgcatgaatagagacgggtcaaataaataggcaaaagggatttttacagttagagataaaagagaaaaccattcactgtattttatttcatttctcctgattcagatatttttagtaatttgcttatatgtaaaagttgtttttgtggagtcagtggatatatttctaatgaagtgctagactatccaattacttaatttcttatacctttagataatcagtatgaaaagttcccatttataatggaaatgaaaattcttaactaaactatacatgtaatatgtatttctagaagagaataaaaacccaagtcagttattagatttaaatcaccttctgaaatgctgctatagggctggtatctgtaaaagaatatcctgatgcatctgtttcaccattttgatttttaaagtatgctgtagcatttcttaataacatcgttgtgatgttcttaaggcagatctttcttcataaaaaggaaagtaatggcaatttctctcctgtggaaatcccaattgcttgaattactgatattttagaatagactttttaaaatgccatatgtaattttatgcaagttgactatatatcttgtacttaataaattataggctcattttgttctctgctagtttaaagtaattcgtttaataatagatgtgtttttagaggaaatgctgttacttggaattaattttccagttatacagtcttctataacttactaataatattctatatgtactttatgtaatttccctaaaaagaatgaactaccactacactatggtgttaaaccaaaatatagggaaaataaacactaactgctgcttatggataatgttgcaactacttgttatgcatataaatattttactttttcacatgtatagattgcatttcttaggtgttttaattttttaaatatatttatgttttaaaaatttagttttgttttctgttttataactatagtgagaatgatgttttgaagcaaaatttttggttataaaatagttttcaggattatatatatatatactggatcctatcgccttttagtagaatatgaaatattcttttagaaatccaatataaataggttataatagccatattctttattactttattgagatataatttacatgccataaagtttacccttaaaatatataattcagtggtttttagtgatatttacaaagtggtacaatcatcatcactttctaattccagaatattttcatcaccccaaaaagaaatcctaaatccattagcagttacttcccattcttcccttcctccagcccctgaaaacactaccatctacttttcatctgtatggatttgtctgttctggacatttcacataaatagactcaaacaatatatggctttttttttttttggtctggcctctttcatttagcttaatgttttcaaggttcatctatgttgtatcacgtatcagtactttattttttgtgtggcacgtcatatggatataccacaatttgtttatcttttcattaattatgggcatttggcttatttctacttttttggctattataaataatgctgctgtgaa

SEQ ID NO: 127669 - DNA, 686 bp, Homo sapiens
  Payload ID: 4986
  Gene Symbol: DNAJB4
  Gene Name: DnaJ (Hsp40) homolog, subfamily B, member 4
  ENST ID: ENST00000426517
  CDS Start-End: 171-686
gttaaggtctcttaagttaagaacagcattgtttcttgaccaaaatagattttgtagcttcttaggcgtagtttctcccaccccatcctgtgggtactcaaatgtaagatcatattctgaattgtcatcacaggactagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaagggttgaaaggaggagcaggaggtactgatggacaaggaggtaccttccggtacacctttcatggcgatcctcatgctacatttgctgcatttttcggagggtccaacccctttgaaattttctttggaagacgaatgggtggtggtagagattctgaagaaatggaaatagatggtgatccttttagtgcctttggtttcagcatgaatggatatccaagagacaggaattctgtggggccatcccgcctcaaacaagatcctccagttattcatgaacttagagtatcacttgaagagatatat

SEQ ID NO: 127670 - DNA, 2391 bp, Homo sapiens
  Payload ID: 4987
  Gene Symbol: DNAJB5
  Gene Name: DnaJ (Hsp40) homolog, subfamily B, member 5
  Uniprot ID: O75953
  ENST ID: ENST00000312316
  CDS Start-End: 173-1219
gggggcgggctcccggtcccgctatcggcggccggcgggcaggcgactcctgtcccgggtggaggcggcggagccggagccgggggagggggcagcggctgtctcacggaccacggcggcgcccgcagctcctcaccgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaatatgg

SEQ ID NO: 127671 - DNA, 484 bp, Homo sapiens
  Payload ID: 4987
  Gene Symbol: DNAJB5
  Gene Name: DnaJ (Hsp40) homolog, subfamily B, member 5
  ENST ID: ENST00000458263
  CDS Start-End: 386-484
gtcccgggtggaggcggcggagccggagccgggggagggggcagcggctgtctcacggaccacggcggcgcccgcagctcctcaccggtatacacgctgccactcacaaacacacgcttgcactcccagcctcactgacacgctgccatacagccgctcacagccagccagacactgctgcacctgagagcaggtggccgcgggtcttctcccttcactctccacatttggggatcaggtccggcacctgctgcgccagacaggccttgctgggcacgcgcctctgagagtccaaggaggtggcttccagagctgcagcacttcaggccggctccggtggagcgatcagagaaacaaggagaccagtgctggtccagtggctgtgatgggaaaagattattacaagattcttgggatcccatcgggggccaacgaggatgagatcaagaaagcctaccggaagatggccttgaagtaccaccca

SEQ ID NO: 127672 - DNA, 615 bp, Homo sapiens
  Payload ID: 4987
  Gene Symbol: DNAJB5
  Gene Name: DnaJ (Hsp40) homolog, subfamily B, member 5
  ENST ID: ENST00000443266
  CDS Start-End: 150-615
cacctcgctcagcagggcctctcaggggtcctcagtctggcccaaggaccagggcctcagcctagccccaagagtgggccacaaccttcagcttcctgctgggaaaacccaggagaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgag

SEQ ID NO: 127673 - DNA, 2589 bp, Homo sapiens
  Payload ID: 4987
  Gene Symbol: DNAJB5
  Gene Name: DnaJ (Hsp40) homolog, subfamily B, member 5
  Uniprot ID: O75953
  ENST ID: ENST00000453597
  CDS Start-End: 29-1417
ctgagctgagtgacaggaagacggttcaatgggcggcgcggaggcggagccgtgggggcgggctcccggtcccgctatcggcggccggcgggcaggcgactcctgtcccgggtggaggcggcggagccggagccgggggagggggcagcggctgtctcacggaccacggcggcgcccgcagctcctcaccgcagcacccccactgcaggcccgaggagctttccggagcttcccacactcctggggagaagacttcttagccagcttgatgtttaaaattcagctggagcccttaaaacttcgagcgtggacgctgaatgggtttgtaaagtttcgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaatatgg

SEQ ID NO: 127674 - DNA, 2818 bp, Homo sapiens
  Payload ID: 4987
  Gene Symbol: DNAJB5
  Gene Name: DnaJ (Hsp40) homolog, subfamily B, member 5
  Uniprot ID: O75953
  ENST ID: ENST00000454002
  CDS Start-End: 382-1644
cattgagtaggttcttggggattggggtcgggtcctccccagtgagaggcgacaggagctcactgcctctcgggccctcacaatcacacctgtcacaggtatacacgctgccactcacaaacacacgcttgcactcccagcctcactgacacgctgccatacagccgctcacagccagccagacactgctgcacctgagagcaggtggccgcgggtcttctcccttcactctccacatttggggatcaggtccggcacctgctgcgccagacaggccttgctgggcacgcgcctctgagagtccaaggaggtggcttccagagctgcagcacttcaggccggctccggtggagcgatcagaggtgaggggcttggctgggcatgtttaagcgcacagtgctctcctgcccacccccagcagcacccccactgcaggcccgaggagctttccggagcttcccacactcctggggagaagacttcttagccagcttgatgtttaaaattcagctggagcccttaaaacttcgagcgtggacgctgaatgggtttgtaaagtttcgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaatatggca

SEQ ID NO: 127675 - DNA, 852 bp, Homo sapiens
  Payload ID: 4987
  Gene Symbol: DNAJB5
  Gene Name: DnaJ (Hsp40) homolog, subfamily B, member 5
  ENST ID: ENST00000469798
  CDS Start-End: 118-435
cgggtggaggcggcggagccggagccgggggagggggcagcggctgtctcacggaccacggcggcgcccgcagctcctcaccgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatcc

SEQ ID NO: 127676 - DNA, 851 bp, Homo sapiens
  Payload ID: 4987
  Gene Symbol: DNAJB5
  Gene Name: DnaJ (Hsp40) homolog, subfamily B, member 5
  ENST ID: ENST00000537321
  CDS Start-End: 235-851
gtcccgggtggaggcggcggagccggagccgggggagggggcagcggctgtctcacggaccacggcggcgcccgcagctcctcaccggtccggcacctgctgcgccagacaggccttgctgggcacgcgcctctgagagtccaaggaggtggcttccagagctgcagcacttcaggccggctccggtggagcgatcagagaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcac

SEQ ID NO: 127677 - DNA, 3068 bp, Homo sapiens
  Payload ID: 4987
  Gene Symbol: DNAJB5
  Gene Name: DnaJ (Hsp40) homolog, subfamily B, member 5
  Uniprot ID: O75953
  ENST ID: ENST00000545841
  CDS Start-End: 381-1427
ggggattggggtcgggtcctccccagtgagaggcgacaggagctcactgcctctcgggccctcacaatcacacctgtcacaggtatacacgctgccactcacaaacacacgcttgcactcccagcctcactgacacgctgccatacagccgctcacagccagccagacactgctgcacctgagagcaggtggccgcgggtcttctcccttcactctccacatttggggatcaggtccggcacctgctgcgccagacaggccttgctgggcacgcgcctctgagagtccaaggaggtggcttccagagctgcagcacttcaggccggctccggtggagcgatcagagaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaatatggcatctgagcaggagcaacaaacctgggatgggggtggctgaggagggccactgtcatcctccctcccgggctctggtcacctttgagaagcccaagcaggccctcagtataagctgaagctgacctctgccttcctcgaagcctcctgggatttctaaaacttatacttcaaacacagcacagacagaaagtaccactcagctattagaagaaacatctatttgggaaggaaaaatatccctgctcatgagagacagagaccattgtcttcagatgtgctagcatgaaaacagattttctcttcttgtctaaattttctctgagtcagacaaattttccttctaggagaaaatttttttctaggagggggtggagaactttttttttttttttttttttttgacacggagtcttgctctgtcgcccaggctggagtgcagtgatgcgatcttggttcactgcagcctct

SEQ ID NO: 127678 - DNA, 683 bp, Homo sapiens
  Payload ID: 4987
  Gene Symbol: DNAJB5
  Gene Name: DnaJ (Hsp40) homolog, subfamily B, member 5
  ENST ID: ENST00000539059
  CDS Start-End: 49-683
aggaggcagatcctgaaagagcttgccctgtgtctgcggaggcaagagatgtatgggcctagagcagctagcagaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagat

SEQ ID NO: 127679 - DNA, 2527 bp, Homo sapiens
  Payload ID: 4988
  Gene Symbol: DNAJB6
  Gene Name: DnaJ (Hsp40) homolog, subfamily B, member 6
  Uniprot ID: O75190
  ENST ID: ENST00000262177
  CDS Start-End: 206-1186
agttgacgccgccgtgccgccgccgcgtgacgcatttcctgtttgttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcactctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggctttgtttatttggttttggcggggagaggagtggtatttgatgctttctgtggacaatgtaaccctaaacacatcatgtattttaaatgccacctacataaataaaacataagcatattgaataca

SEQ ID NO: 127680 - DNA, 398 bp, Homo sapiens
  Payload ID: 4988
  Gene Symbol: DNAJB6
  Gene Name: DnaJ (Hsp40) homolog, subfamily B, member 6
  ENST ID: ENST00000439402
  CDS Start-End: 264-398
ttcactatgttgttcaggctggtctcgaactcctgacctcaggtgatccacccgcctcggcttcgcaaagtgctggattacaggtgtgagcccgcgcgtccggctgtcactttaaagagtattataagagggcacttcataacttgggcaggtatttttagtcatcctgaacgtgtcgctgtggactgggtgtcaccgcgggaccgcacagacaccttactgtcgtctgctgtaaaggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaa

SEQ ID NO: 127681 - DNA, 566 bp, Homo sapiens
  Payload ID: 4988
  Gene Symbol: DNAJB6
  Gene Name: DnaJ (Hsp40) homolog, subfamily B, member 6
  ENST ID: ENST00000437030
  CDS Start-End: 368-566
accaccagcgcagcagtcctggagctgtgaggagattcgggccgtcaccctgcctcccctgcgtcccgccaccggccgcttctgtcctcgaaacgggagtggcttgcggagcaggaatgccgcagccgtgccgccaagttcggagggagaagaagcaggtgggggaccgcaaagccctgtttctagaactccggacggattgttcagaagtttgtggaagagcaggctgcctttctcactcagaatgtttgtctgctttgctttgcgttaaagaatctgcaccgtagttgatgcaactgaagtttatataagaagtttacattaactcttacctaaggaaggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgaca

SEQ ID NO: 127682 - DNA, 590 bp, Homo sapiens
  Payload ID: 4988
  Gene Symbol: DNAJB6
  Gene Name: DnaJ (Hsp40) homolog, subfamily B, member 6
  ENST ID: ENST00000453383
  CDS Start-End: 296-590
actcgcgtctgaaaccagaaacgggagtggcttgcggagcaggaatgccgcagccgtgccgccaagttcggagggagaagaagcaggtgggggaccgcaaagccctgtttctagaactccggacggattgttcagaagtttgtggaagagcaggctgcctttctcactcagaatgtttgtctgctttgctttgcgttaaagaatctgcaccgtagttgatgcaactgaagtttatataagaagtttacattaactcttacctaaggaaggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatg

SEQ ID NO: 127683 - DNA, 1159 bp, Homo sapiens
  Payload ID: 4988
  Gene Symbol: DNAJB6
  Gene Name: DnaJ (Hsp40) homolog, subfamily B, member 6
  ENST ID: ENST00000443280
  CDS Start-End: 147-782
agagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatg

SEQ ID NO: 127684 - DNA, 1609 bp, Homo sapiens
  Payload ID: 4988
  Gene Symbol: DNAJB6
  Gene Name: DnaJ (Hsp40) homolog, subfamily B, member 6
  Uniprot ID: O75190
  ENST ID: ENST00000429029
  CDS Start-End: 206-931
agttgacgccgccgtgccgccgccgcgtgacgcatttcctgtttgttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaaaaaaagaaaataaatgcgaatgtgttggtgcattcttcctgagtgggatctgga

SEQ ID NO: 127685 - DNA, 852 bp, Homo sapiens
  Payload ID: 4988
  Gene Symbol: DNAJB6
  Gene Name: DnaJ (Hsp40) homolog, subfamily B, member 6
  ENST ID: ENST00000417758
  CDS Start-End: 168-852
gttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggtgagggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaa

SEQ ID NO: 127686 - DNA, 506 bp, Homo sapiens
  Payload ID: 4988
  Gene Symbol: DNAJB6
  Gene Name: DnaJ (Hsp40) homolog, subfamily B, member 6
  ENST ID: ENST00000412557
  CDS Start-End: 131-506
tttttctaaggctcccgcactcgcgtctgaaaccagaaacgggagtggcttgcggagcaggaatgccgcagccgtgccgccaagttcggagggagaagaagcaggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatc

SEQ ID NO: 127687 - DNA, 1022 bp, Homo sapiens
  Payload ID: 4988
  Gene Symbol: DNAJB6
  Gene Name: DnaJ (Hsp40) homolog, subfamily B, member 6
  ENST ID: ENST00000441561
  CDS Start-End: 586-1022
atactaatgtggtaatcagtgaactatttgcttccgtttccttcagtcactattccctggcgaagtctccacgcgctcccgttcgccggggaacttagggtatccgggcttccctaaattgacaagcgggggccggcgccttcgcccgccttcgctggccgccgcttggtttgttcttcttctccttcggggacttctccgcccgcgcccgcgcccgcgccccagctttcgtcccgctgtgcggagatgccacccagctccaccgcaggaccgcggagcgagaggcggcagacgcgctccgggggccgccggtcaagaggaagatgaagggcgcgacgacttcgcggtttccagaatgggctccttctggcccaacaataagtgccatttggaatcttctcggccttctctgtgccttccgcgcgtctgggctccccggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtgg

SEQ ID NO: 127688 - DNA, 614 bp, Homo sapiens
  Payload ID: 4988
  Gene Symbol: DNAJB6
  Gene Name: DnaJ (Hsp40) homolog, subfamily B, member 6
  ENST ID: ENST00000441291
  CDS Start-End: 126-515
gccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttggacagggcagtgtttgggttgaagtcctgtgttctgatcggtgattctcatggtgaccaagcgaggaagaaggcccgctcttccaacaccatggcttctcttctggggcacacgagaagacccttttgaggacttctttggga

SEQ ID NO: 127689 - DNA, 7992 bp, Homo sapiens
  Payload ID: 4988
  Gene Symbol: DNAJB6
  Gene Name: DnaJ (Hsp40) homolog, subfamily B, member 6
  ENST ID: ENST00000459889
  CDS Start-End: 149-1153
ggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcaggtgtgcaaagggaggcagccgtggagcaggcgcagagtgagacttctctgggtgccagaggacagcgaggacacaaaccgcgcctgggctgctgtgttctgacctgagcgggcgtgggcggtcgggcggggcgggaggaggtagcctcgctctgctcctctcccgctcgcggcgccccacgccacggtggctccgggccccccaccgttaaaacggggtccgcgtgtcctgtacgcagcgtgttgctccgcaaaggatgacagagctgccacggcagtgcgaggtgctgcttttaccgtagacgtgccttttcgtagctttcagcgtagagcttgaggcctgtggcttaggccgggtggtctcgtgctggtggggtctgcgtttgcccctgcccctccgtcagcttcaccttctcgtgccttcttctgcgctgggtgcagaacaaaagaccccctcaagtcaagcctccttgtgaagcgtagtctgcccgcccaccccccgtggggttcttggccgccctgccctcctcccacctgttagggagccggatagtctctgaagtgagtgccccggagaagttctgggtcaccctgaggacgtgctgtgcatgtaggcttggccctgactgcgtcctaaagcccagggtccatgtagtgtgaatcgtgcgtcagttggaagtatttgtgcctcttctggttcttatcaccgcacgcggtgaggtgaccccagccgctcatgtcgtgcaggaagacatggatggttgatccctgggtttgggggaccgaagcggatgtcgtgaggttacttctgtggacttgggccgaacagcactgtctaagcaggacatgaaaagaagggggaagcgtctctccttttcccttcatggaactttccattgaaaaattagccccttccagtccttctcggatgaagcacagttgccggttacgcttccgaggaggacggaaggtgcacccccagccgtgagagcctcaggatgtgccgcctgtgggtgggcacggcagcccctccagccggccgcccacctgccgtgctgcgctcacctttgctgtgtgagtctgtgctgtgtcactgagtgacagacagaggcagttgcaggctgcatgcacccagaaagaactccccctgcactaagcgggcatgggggaggctccccagggtccctgcactgagcggggtgggggaggctccccacggttccctgcactgagcggggtgggggagactccccacggttccctgcactgagcgggcgtggggaaggttcccaggatccctgcactgagcggggtgggggagactccccacggttccctgcactgagcgggcgtggggaaggttcccaggatccctgcactgagcgggcgtggggaaggttcccaggatccctgcactgagcgggcgtaggggaggctccccaggatccctgcactgagcgggcgttggggaggctccccagggtctgttgtgcgctcctggtactggagggtctgatggccgtagggagggtgcactgtttgtcgatgggtctttgcaaggtgcaggatagagcagggttgtagctgtagtgtccctgaaccactggggttaggaggccaccggaagcctggcctgctaggggccttgtgatttcgcaggccccgagaacgtggtgtgcaggtgcgggccgcctgggggagccatgtttaaagtgcggtgaggctcctggaacggcacccaccgcaggcccgaggccacacctgtatgtcagaactgggcgggtcttctcctcccaggccttcagcgcctgtggctatggctgtgggcgggactgatacgggcaggcaggcgctgttctccccacgtattctcggcttccccgccatacaccgtttctgagtggggagaactggttgactgctgaatcccaacacaaatccttagagcaaagaggccagtgatggcttttgtttctgcccggatcctctttgtggatcttccgttttgcggcttttcctctcatttgtttcctttttttaatcgcttcatgagatcttgaagataccaaagtaaccatcaaagatttaaagacgtgatttttatacaaatatataacgaacacgtcagagacttttacttaagttcttactgagagatgacaaagctgactcaaaggatgagtcaagaaaccgctgcagagttggagacagaactggagtgaaattgcaaagcagggtggttttggtctctgcagaggccatttgcgactcactcaccaactccggtgtcagggtgctggtgggtgacagggaagaggttgagcaagcctccgcccctgcaggctcgctcattatacaatgagcacctgcaccaccaaatccgaacaactgtacatgcttacagagaagggcacgtgctagtgtgggagtgacaaagtcacacgggtgcagaccccttagctccagcctgctgggtgttctgacgaatggactttgtagcgataacacaggctcctgagtcaggatactggtttgctgcatttctgcgtcactgaaggtctcgctttccccgaagccccttgtcacagaaaacccatgactcttggccaggcctctgggtgcctggaagatcccactatcatctttttgtgggatttgcatgtcctggtcaaggttcctgtaaaaggaatacagtgaggagaccggccacccgacagtattgatggcccccactttggcctccagccgtctgacccgtccctgaatcgagcaggtcctgtcggagctcccaggagtgagcgagcttccactcacagggtcacagccaggtgtgcagcccccaggcctgggcggttctagggcatgattttttttaggctggaaatgagctctcacttgagatgcacccctcaaaatactgaacgtactgcttctgtgagaatttcccctccttgtgtctggtgtgattgacaacgggtgcagccagtggaagcaggaatgtcggggagcgcggggtgcagggggtgccctgtcacagtcagcggggagcgcctgtccctgctgcgtggtgtggggttcccgtggctggcatttgctgctgtgtggagtcctcaaacccagcgctcgccctgcctgcgttcagaggacagaggcaccaccgggaacccaccggatcctcactcaggctttggaaaggccgagtgatgttttgtgtttgtgaattccacacatactgtaggagtatcaagaacacgtaactgttaaaaaaggaaaagtaaaattactgaacaggaaagaaagaataaagcaggtcctttgtttttttggctgaggaaagcagcctgccctggaacgctgtagaatgtctccctttttgtgaagcacagcatggagctctcggaactgaagatgggaatctaaccctgccctcagctttcaacagctcgaagtttgtctttttaatgaaactaatttgtgtatttatacttaagggttttcaagtccttaaacttgataagaaaacttaagtcgttttctatcaggacaagtttttaagtagtcactggtgggagagcgtgcctctgtggactgtgcccaaggctggcggtcccacgaagtcccagagcccgcgagccggtgcccaaggccatgtctgtgatttgcaggaggttcaggtgacaggaaggcctgctctgtttttctcacttcaattttggacttttttttttttttttttttttttgagacagtctcgctctgtcgcccaggctggagtgcagtggcgtgatctcggctcactgcaacctctgcctcaagggttccagcgattttcctgcctcacctccccagtggccggaactacaggtgcttgccaccacttctggctcatttttgtatttttagtagagatgtggtttctccatgttggactggctgctctcgaactcctgacctcaggtgatccccccgcttcagcctcccaaagtgctgggattacaggcgggagccaccgcgcccggcaatagtggaggcttgaagaacaccggaaagtggtttccttgtaccggacccgcccctcccccaccatcccggcagccccagggcgggtgagggcgactgcagtgtggtcacctcaggctttccgtccctagctcataaaggcccagtggcagcagttgctttaaaggagctccgttactccctttgttctggggtcttggtaaagtttgctttgctgaagcggaggaaccgcaggcggtgctgacccccccaccccgcccccatcccacggggtcccttgggtcccggggcacgaggctcctctgagggacacggcctccaagagctggctctgccctggccgccctccacagtcacggcggctccccgcatgctcctcgggacggagatctcctggcttcctcccgcttcctttcctctgcgttttccgcagagccgcctccctgctttggaagcaggtactcagcggcctctgcagccgccaacggcacacaggcctctctctgttcgttctttctttccgtaaccgtagcttgaggcacatttcctaaatatgcagcatggaacgcttggcggttctgaacgcgcatctcgtgctgctcctgtagggcggttaggacgcgctcctctggcgaggaaggtggcagcctccactgtgcacgggtcacaggcgagtgtggtgtggtgtggttgtgggtggggtgtggactggatctgcaggcttgtccctctctcgtggagagctgtcggggtccaggcagtgctcagtggtgagagccacagcacatttgaaagtccacatgtgtttgccccactgtggtccaggacatgtgtgagccacactcagtggacttgcacctgtgacatgttggtcagcgtggcggccgtcagctgggtgtggaatgcatctgattggagcctggcacccggcctaccatgattgtgattctctggggcgagtcctgagtgtgggcagggcctcaggcccccaagagggctgtgagcaggcaccttcctgtgaggcacgatgccaccatgtgaagttgtgtgggtctttggagagttctggcaggttgagggcctgtgcgtgtgggacccaggcctgccctgcctgctgccggccatgttccctctgcccagtcatgttgacaattgtggccaaattcaacatcgggcctgtttcctgcacccacgttggcacacactgagttcaagacagtttctgcagaaatgaatccagaggtgtttatttctggcacgttggatcagacgttcagagggtgggcgtctttctccatgcacttcagctggatcagtcagtgtcagccattgactttagcaacagggaaatgaaagactttcctcaataagaaatgggactttctcacgctggatggcacagagctggcaaacatgaggccagtccacaccaaggctttgcctgcagaaaggctgcactgtggccagcgggggaagcggaggagacacctgtggacaccctccccacaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcactctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggctttgtttatttggttttggcggggagaggagtggtatttgatgctttctgtggacaatgtaaccctaaacacatcatgtattttaaatgccacctacataaataaaacataagcatattg

SEQ ID NO: 127690 - DNA, 1005 bp, Homo sapiens
  Payload ID: 4988
  Gene Symbol: DNAJB6
  Gene Name: DnaJ (Hsp40) homolog, subfamily B, member 6
  ENST ID: ENST00000634080
  CDS Start-End: 1-1005
atggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcaggtgtgcaaagggaggcagccgtggagcaggcgcagagtgagacttctctgggtgccagaggacagcgaggacacaaaccgcgcctgggctgctgtgttctgacctga

SEQ ID NO: 127691 - DNA, 2578 bp, Homo sapiens
  Payload ID: 4989
  Gene Symbol: DNAJB7
  Gene Name: DnaJ (Hsp40) homolog, subfamily B, member 7
  Uniprot ID: Q7Z6W7
  ENST ID: ENST00000307221
  CDS Start-End: 133-1062
taacattgtctttaacataaaagtgtacctatttgcagtcactacctctatcaccaccaccagcagagcctgagctgaggaaaccacggttctcaatacccagcacacccacttccaactatctgttaaaacatggtggattactatgaagttctaggactgcaaagatatgcttcacctgaggacattaaaaaagcttatcataaagtggcacttaaatggcaccctgataaaaatccagaaaataaagaagaagcagagagaaaattcaaagaagtagctgaggcatacgaggtattatcaaatgatgagaaacgggacatttatgataaatatggcacagaaggattaaacggaggtggaagtcattttgatgatgaatgtgagtacggcttcacattccataagccagatgatgtttttaaagaaatttttcatgaaagggatccattttcttttcacttctttgaagactcgcttgaggacctgttaaatcgtccaggaagctcctatggaaacagaaacagagatgcaggatactttttctccactgccagtgaatatccaatttttgagaaattttcttcatatgatacaggatatacatcacagggttcattggggcatgaaggccttacttctttctcttccctggcttttgataatagtgggatggacaactacatatctgttacaacttcagacaaaatcgttaatggcagaaatattaatacaaagaaaattattgaaagtgatcaagaaagagaagctgaagataatggagagttgacattttttcttgtaaatagtgtggccaatgaagagggctttgcaaaagaatgcagctggagaacacagtcattcaacaactattcaccaaattctcacagctccaaacatgtatctcaatatactttcgtggacaatgatgagggaggtatatcttgggttaccagcaacagagatccccctattttctcagcaggagtcaaagagggtggtaagaggaaaaaaaagaagcgtaaagaggtgcaaaagaagtctaccaaaaggaattgttaaattgactcttcaaatatataacatttgaacacaattgtgtgtgttttggttaatcacaaattttgtagataacacttaatactatactaagagcttttcaacacttttagcaggattgtggacatttggttagtagtttttttgaatgggtatgtcagaaaaggatgagtttgtggtgacagttggtgctaataagaatttgcctgggcagtatagtgagatcttttctctacaaaaaatttaaaaattagccaagtgtggtggtgtgcacctgtagtcccagctactcgggaagctggtagaaagactgcttgagcctggaagacataggttgcagtgtaatgggatcacgccactgcactccagcttgggtgacaaagtaagaccctgtcttaaaaaaaaaaaaaaggaatttggaaaactgcaatgagttttttacttttgaatttttctttagtagagtttatagcctatttttcttttttctaattaaaaccactatacaaacttacgaaacatgcatagcattagaagacaagaatgtatcaagacacacaggttcagactacacaattattcatgaaatggctgttttccaatggaggaacagcatttgatgcattataacttaaaggtactacaaattaaaaattaaagtataaagtattttaagttagaaatagacttagctgggtgcagtggctcacacctgtaatcctagcatcttgggaggcccaggcaggagggttgaagtcagaatttcacgacagtccgggtaacataatgagacctgtcctctatgaaaaaacttttttaaaaatttagctgggtgtggtggtacgtgcctgtaggcctagctacttaggaggctgaggtgggaggattgcttgagcccaggagtttgaggttgtagggagctatgatcttgccattgcactccagctgagagtgtgaccctgtctctaaagaaaaactatagaaaatttaaaaaattaaaaaacgggtaacatggtaaattttatgtagtatattttaccacattttttttaaaggccagtcttatcctgaattcctcagagcagtctgtatggtaggccatcagtgaatcactccagacaggaaattttctatttttgtttagagtttgtacacaaaatctacaaatacattactctaaaatagcacctatagccattttaatttagtcatgttgggagaaaaatagatgggttacaaatacatcagatatcgagcaaatggtttgagttacatctagcagcactaaaacttattcaactttggccaaatacaaatgcgaaattagaaaaaaattataatatctgctatttttaaaagacagctatagtcaagagcttgtgttttgtatcggtatttgatttttagtgggcagatgggagaaggaaaggttatttattctatagaagagactgcggacaattagtattcaaagtttattttcagaaaataaaataataaaagcccagggtattttaaa

SEQ ID NO: 127692 - DNA, 2465 bp, Homo sapiens
  Payload ID: 4990
  Gene Symbol: DNAJB8
  Gene Name: DnaJ (Hsp40) homolog, subfamily B, member 8
  Uniprot ID: Q8NHS0
  ENST ID: ENST00000319153
  CDS Start-End: 1662-2360
acaccgcctttgccatcaccaccgtcattgccccctctactaccaccaccatcaccaccaccgggtctgcctcagccagacccaccactgcctctaattagactgccaccatcatcactgccaccaccactgcccctccaatgccttcctgatgtcaccatctgctttctctctgctatcctcacacccaactccatcacaaccaccaccttcatctgagccgccatcaccctcacagtacacagccctcaaatgtgtaccaaggaggaggacatttactacacgctgcaccctgaacagtctgggaccagcggtcagggaacaaggaatcgagatgctcacctgcagctcccaggtgagcggctctctagagcttgcctgggagctgctgaggagctcacggtattccaggaagctccccatccatgcctcagcctgtggctcagaagcagggtcttcgcagaagattgccccgagctgttgcaaagctcaccattgtcacctgcctgcaacggcctctcttttccactctccaaatcccttgtattggcaggctctagtctggaattataccggtgatgggattctggaaaatccctcagatttctccaggatgcaaggagaccatggaagaggaacaagcctgcaagggacagcaggtgctaactgctaaccgagacatagtgacaaaaatccagccacagagataaagaatcaggttcatctgtagctacatccagtggagaagttctgctcttcaactcctctgctaagccacatgtgtcagcaggtgtagaattgagtggaacacttctttggatttgctgtccgctgcagccttggccctggtttcacatcccctccctcactgactcgctgtgtgaccttgagcactgtgtgtctctgagcctggttcatccaagagtttaccgacggccctcgtgtgccagccactgtcctagacagggacagactttcccgcctttgtggagcttaccccggaagacctggccagataatgggcacaaaaaaagcaggctcttgtccccaccccagcctgcctgaaccccaccttggcctcctcttgcctcagctgctgcccagccatcggccgagtggacatacccaggacgcccttgcccgcctcccccaccacggccacagacctttgtcactcaccaaggctggaatcccgtggctgatcctgcctctgccctttggctcccgggactcagcccacaccacctgggtcacagagcatcccattcccacacaccgttgtggccacctcaccagcaggggcaggcccatatgcccaggtttgcctggtgaggagctgggggcgggggtatgccccgccccgggagctgacgtcataaaaggagctctggagggcagcccactctggcctggccccacagcggcagtgtccctcccctccccccactcctctcagtgggggcccctccagtccctgagaattggtactacgaaaaggtgaactcctgggcagaatcttgcctagagcttgcggagtccagccaggcccctgctgaagggccccagaccaccggccacttctcccccgtccatctgaccagctgggcccctgcgcccacctggcctccacgttccctctcctctcacccacacccctggccatggctaactactacgaagtgctgggcgtgcaggccagcgcttccccggaggacatcaagaaagcctaccgcaagctggcccttcgttggcaccccgacaagaaccctgacaataaggaggaggcggagaagaagttcaagctggtgtctgaggcctatgaggttctgtctgactccaagaaacgctccctgtatgaccgtgctggctgtgacagctggcgggctggtggcggggccagcacgccctaccacagccccttcgacaccggctacaccttccgtaaccctgaggacatcttccgggagttttttggtggcctggaccctttctcctttgagttctgggacagcccattcaatagtgaccgtggtggccggggccatggcctgaggggggccttctcggcaggctttggagaatttccggccttcatggaggccttctcatccttcaacatgctgggctgcagcgggggcagccacaccaccttctcatccacctccttcgggggctccagttctggcagctcggggttcaagtcggtgatgtcgtccaccgagatgatcaatggccacaaggtcaccaccaagcgcatcgtggagaacgggcaggagcgcgtggaggtggaggaagacgggcagctcaagtcggtgactgtgaacggcaaggagcagctcaaatggatggacagcaagtaggcgctggccacccggccctgccttcccaccaccaccaccgtgcatggggcagcaaacacgtggggccgcagacatagcctgatggttaataaatgtgccaagtga

SEQ ID NO: 127693 - DNA, 3365 bp, Homo sapiens
  Payload ID: 4990
  Gene Symbol: DNAJB8
  Gene Name: DnaJ (Hsp40) homolog, subfamily B, member 8
  Uniprot ID: Q8NHS0
  ENST ID: ENST00000469083
  CDS Start-End: 2559-3257
acacgctgcaccctgaacagtctgggaccagcggtcagggaacaaggaatcgagatgctcacctgcagctcccaggtgagcggctctctagagcttgcctgggagctgctgaggagctcacggtattccaggaagctccccatccatgcctcagcctgtggctcagaagcagggtcttcgcagaagattgccccgagctgttgcaaagctcaccattgtcacctgcctgcaacggcctctcttttccactctccaaatcccttgtattggcaggctctagtctggaattataccggtgatgggattctggaaaatccctcagatttctccaggatgcaaggagaccatggaagaggttggtgtaatgccaagttagcaacagaaaatacagagccccacacctcagtgccatcaccatcgccatcggcactcacaccagcatgtccaccactgtgtccttctcacccctcggcacccccctctaccattgcctcttccacaaccaccctcaccaccatcctccattaatagcacaattcctgcctcctatcccatcaccaccacgggtgtccccggcaccagcagcaccaacactgctcccagcagagccatcgttaccagccccgctgtcagtcccatcttgagcatctggcatatgttggagaactgctcactccctcttccccatgggaatctcaggcctctcttcctattgccctgagatttgcagaaccttcctgaaggaaacattctttgccccatggatactggccttgaccatgggatgcagcaagactgccacacatcatggcccaacagaagctttcagaggcagcccaagttcctgctgtctctgagtggcactgtcatgagagaggggtgtgcaggtcagagctgattctccagcctgggacccacagtgagaagctatgggaggtggggccctggcagctgcctgtaggcaccagtgagtgaagtggggggaactagatgtttgtcgtgagccactgagaggtggaagctgtcactgtggtatagccgaacaagatacaacctctgctacctccaccaccttcaccttcatcatcaccattactgtcaccactgccaaccacaccaatggctcactaggagccattcccatcacctcctcatcatacctgcaccatcactgccaaccacaacaaaggctcgctgttaccatctcctctggcatgaccatcaccaccaccactaccatcatcaattactctcaagcacaagccttgctgctgtcaccaccagcatcaccatcatcatgatcaactccaccatcacccataattactctccccctcacacccaccatgaccattacctccacatcaacactgctcccatggtcacctctactatataatgacaccttatccatctccatggacacccaccgtgcctctccccaccagcaacacagtcaacagcagtgcctctcccactgccaccgccatcatggagaactgtgcagggcaagcatctttctcccgccccaggaacaagcctgcaagggacagcaggtgctaactgctaaccgagacatagtgacaaaaatccagccacagagataaagaatcaggttcatctgtagctacatccagtggagaagttctgctcttcaactcctctgctaagccacatgtgtcagcaggtgtagaattgagtggaacacttctttggatttgctgtccgctgcagccttggccctggtttcacatcccctccctcactgactcgctgtgtgaccttgagcactgtgtgtctctgagcctggttcatccaagagtttaccgacggccctcgtgtgccagccactgtcctagacagggacagactttcccgcctttgtggagcttaccccggaagacctggccagataatgggcacaaaaaaagcaggctcttgtccccaccccagcctgcctgaaccccaccttggcctcctcttgcctcagctgctgcccagccatcggccgagtggacatacccaggacgcccttgcccgcctcccccaccacggccacagacctttgtcactcaccaaggctggaatcccgtggctgatcctgcctctgccctttggctcccgggactcagcccacaccacctgggtcacagagcatcccattcccacacaccgttgtggccacctcaccagcaggggcaggcccatatgcccaggtttgcctggtgaggagctgggggcgggggtatgccccgccccgggagctgacgtcataaaaggagctctggagggcagcccactctggcctggccccacagcggcagtgtccctcccctccccccactcctctcagtgggggcccctccagtccctgagaattggtactacgaaaaggtgaactcctgggcagaatcttgcctagagcttgcggagtccagccaggcccctgctgaagggccccagaccaccggccacttctcccccgtccatctgaccagctgggcccctgcgcccacctggcctccacgttccctctcctctcacccacacccctggccatggctaactactacgaagtgctgggcgtgcaggccagcgcttccccggaggacatcaagaaagcctaccgcaagctggcccttcgttggcaccccgacaagaaccctgacaataaggaggaggcggagaagaagttcaagctggtgtctgaggcctatgaggttctgtctgactccaagaaacgctccctgtatgaccgtgctggctgtgacagctggcgggctggtggcggggccagcacgccctaccacagccccttcgacaccggctacaccttccgtaaccctgaggacatcttccgggagttttttggtggcctggaccctttctcctttgagttctgggacagcccattcaatagtgaccgtggtggccggggccatggcctgaggggggccttctcggcaggctttggagaatttccggccttcatggaggccttctcatccttcaacatgctgggctgcagcgggggcagccacaccaccttctcatccacctccttcgggggctccagttctggcagctcggggttcaagtcggtgatgtcgtccaccgagatgatcaatggccacaaggtcaccaccaagcgcatcgtggagaacgggcaggagcgcgtggaggtggaggaagacgggcagctcaagtcggtgactgtgaacggcaaggagcagctcaaatggatggacagcaagtaggcgctggccacccggccctgccttcccaccaccaccaccgtgcatggggcagcaaacacgtggggccgcagacatagcctgatggttaataaatgtgccaagtgagtt

SEQ ID NO: 127694 - DNA, 2715 bp, Homo sapiens
  Payload ID: 4991
  Gene Symbol: DNAJB9
  Gene Name: DnaJ (Hsp40) homolog, subfamily B, member 9
  Uniprot ID: Q9UBS3
  ENST ID: ENST00000249356
  CDS Start-End: 547-1218
atgactcgggtgaggcccctggagaccggggccggcgacggatgcagggcggccctcctcactgaggatgcgccacaggtccaggcctctcgagcccctgcgcctgcgctagcattctgccgggaaagccgcctcgtctgtcgactcacttccgcctcctccggtttaagcaccgccttttcgggggttgaagccggaagtggcgcacagccctagcagcaacaacagttttccacgtgcgcgtagggcgccgggatcacgtggggaggcagaagccaatggggaagcgtttcgtgtaggtcttctgaggtggtggcgccagcggctacctcctgcctgtgaggagctggctgagaggggactgggcgccggcggggaaggaggagcgctaggtcggtgtacgaccgagattagggtgcgtgccagctccgggaggccgcggtgaggggccgggcccaagctgccgacccgagccgatcgtcagggtcgccagcgcctcagctctgtggaggagcagcagtagtcggagggtgcaggatattagaaatggctactccccagtcaattttcatctttgcaatctgcattttaatgataacagaattaattctggcctcaaaaagctactatgatatcttaggtgtgccaaaatcggcatcagagcgccaaatcaagaaggcctttcacaagttggccatgaagtaccaccctgacaaaaataagagcccggatgctgaagcaaaattcagagagattgcagaagcatatgaaacactctcagatgctaatagacgaaaagagtatgatacacttggacacagtgcttttactagtggtaaaggacaaagaggtagtggaagttcttttgagcagtcatttaacttcaattttgatgacttatttaaagactttggcttttttggtcaaaaccaaaacactggatccaagaagcgttttgaaaatcatttccagacacgccaggatggtggttccagtagacaaaggcatcatttccaagaattttcttttggaggtggattatttgatgacatgtttgaagatatggagaaaatgttttcttttagtggttttgactctaccaatcagcatacagtacagactgaaaatagatttcatggatctagcaagcactgcaggactgtcactcaacgaagaggaaatatggttactacatacactgactgttcaggacagtagttcttattctattctcactaaatccaactggttgactcttcctcattatctttgatgctaaacaattttctgtgaactattttgacaagtgcatgatttcactttaaacaatttgatatagctattaaatatatttaagggttttttttttttgacaaattcaacattcaacgagtagacaaaatgctaattatttccctgattaggaaagtttctttaaaaaacacgtaattttgcctagtgctttttctctacctgcccttgggctcactaatatcaccagtattattaccaagaaaatattgagtttacctgattaaactttaaaagttaattgtagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctcattctgtttgtaaaaccagccagtaatttctgtgcaaccttactatgtgcaatatttttaaatcctgagaaatgtgtgcttttgttttcggatagacttatttctttagttctgcacttttccacattatactccatatgagtattaatcctatggatacatattaaaacaagtgtctcatacaacattgtatgtgagagaaatataaatatttacaacctgatattcgttgttgttttattgttaaaagtttattatgcaactctggaggtatagagggcatataagctatgggacatatgctgatcacaggctatattcatgaagttacttttgaccaacctgaaaactgataggattttgtttgtcatttggtaatttctactgcattcttaccatccttctctcacaaattttgatagcttgaagatctttttaattataattttgttgtatttgtttcctaggagcaagtgttcctgctgccagttctttcctctttaggcgtggttgagaaaaagcagaaactttacataaagctgtatttcttaatcatctttaatttgaaacttaagaaaatgaatttattctgttatatttatgtaacttatttcctggaagttatatctactagttttgtttgataataataaaattagctataccttgaa

SEQ ID NO: 127695 - DNA, 2268 bp, Homo sapiens
  Payload ID: 4992
  Gene Symbol: DNAJC25
  Gene Name: DnaJ (Hsp40) homolog, subfamily C , member 25
  Uniprot ID: Q9H1X3
  ENST ID: ENST00000313525
  CDS Start-End: 57-1139
gcgcggctgagtgctgcagaatcgctggggtggcagagccgccagcgaggctggggatgggggcgccgctgctctctcccggctggggagccggggctgccggccggcgctggtggatgctgctggcgcccctgctgccggcgctgctgctggtgcggcccgcgggggccctggtggaggggctctactgcggcacgcgggactgctacgaggtgctgggcgtgagccgctcggcgggcaaggcggagatcgcgcgggcctaccgccagctggcccggcgctaccaccctgaccgctaccggccccagcccggagacgagggccccgggcggacgccgcagagcgccgaggaggctttcctgctggtggcaaccgcctacgagacactcaaggatgaagaaacacgaaaagattatgattacatgctggatcatccagaagagtactacagccattactaccactactatagcaggcgcttggcccctaaggtggatgttagagtagtgattttggtcagcgtgtgtgctatttcggtgtttcagtttttcagctggtggaatagctacaataaggcaatcagctacctagccacagtgcccaagtaccgtatccaagctacagagattgccaagcagcagggactgctcaaaaaagccaaagaaaaaggcaaaaacaaaaagtccaaagaagaaattcgtgacgaggaggagaacatcataaagaacattataaaaagtaaaatagatataaaggggggctatcagaaaccccaaatctgtgatcttctcctgtttcaaattatcttagctccttttcacctatgctcatatatagtttggtattgtcggtggatctataattttaacatcaaaggcaaagaatatggagaggaagagagattatacattatacgtaaatctatgaagatgtcaaagtctcaatttgatagtctagaagatcatcagaaagaaacttttcttaaacgagagctctggatcaaggagaattatgaggtctacaagcaagaacaagaggaagaattaaagaaaaagttggcaaatgaccccagatggaagagatacaggagatggatgaagaatgaagggcctgggcggttaacatttgtggatgactgaagattgatggaatgctactatgccaaaccttaattgtgatattattttcataactgaattattttagaaatgtatcaattgactgctgctcagcagtaactaaaattcctcaagtatttgattaaacagaataatgtcaaaatttaaaccttcccttaaaactttatacataagacatttatgattgttcaatttttataatctatttgtggattttgttaaaagatttcacatgaagatttattagttgccatttaaaatttttatatgtttagttaaaagatttgacatgaaaatttattagataccatttaaaaattttatgtgttatgtgtttattctttgagaatgttaccttactgtttgtaatagtgctacatttttctgctttcatggcctctgtattttcacaaaacaccaaaaacagcatttaattatattatcatgagtgtgtttctggacacaaacttctgcagtagaatgacctaacatgtcgttttcattgcagtcattataggattgaaatacgttcaaaataacctctctaggaaagtcttctgctagaatttctcccctctattcattataatattctttgtttttaaagccagtcaaatataatagtcttaataagatcagaaactctccaggagagtgagtctaccctcacgtccttgtaggatgatcttgattatagtcttattataggactataactgtattctcaacatttctccagaaaggaccttgtaaaaaggtcttttgtaccacagtattggttttttcccctctctcttcacttaaaaaaaaaaatagcaaggcagaaatagtgtattgaaaagttgttcatctattatgaagtccttgagtggtgaaaaatccgttgtacatgagaacatttctatgcatttaagccagaaacgaggtacatggctgtgtgctcttctgtcaaccaatgaaatgtgttttcacatgtgtggcagtgcaagtaaataacacattatttgactgaatcaggcatgatactgcaccaaagtgttggtacatattcacggtagtaaatcagtacccctgttaaaggatttatcccattgcttcatattaataaaatggttacaatatatcacaa

SEQ ID NO: 127696 - DNA, 2498 bp, Homo sapiens
  Payload ID: 4992
  Gene Symbol: DNAJC25
  Gene Name: DnaJ (Hsp40) homolog, subfamily C , member 25
  ENST ID: ENST00000447096
  CDS Start-End: 49-456
gagtgctgcagaatcgctggggtggcagagccgccagcgaggctggggatgggggcgccgctgctctctcccggctggggagccggggctgccggccggcgctggtggatgctgctggcgcccctgctgccggcgctgctgctggtgcggcccgcgggggccctggtggaggggctctactgcggcacgcgggactgctacgaggtgctgggcgtgagccgctcggcgggcaaggcggagatcgcgcgggcctaccgccagctggcccggcgctaccaccctgaccgctaccggccccagcccggagacgagggccccgggcggacgccgcagagcgccgaggaggctttcctgctggtggcaaccgcctacgagacactcaagtcctcctgcatatgcccaagaggattgggagtggaatggacaccagcagaagcaccacagttattcctgtagagattagaaacaaggagcttattgccctgcttgtcaaggctcaggacagacaggaggaagaaacaagtataaaggttttggttttggaaagaagttggaatctccagaccctgggaccttaagatccacaaaattgctgaaagaaaaagtactaccttattgaaaggatgaagaaacacgaaaagattatgattacatgctggatcatccagaagagtactacagccattactaccactactatagcaggcgcttggcccctaaggtggatgttagagtagtgattttggtcagcgtgtgtgctatttcggtgtttcagtttttcagctggtggaatagctacaataaggcaatcagctacctagccacagtgcccaagtaccgtatccaagctacagagattgccaagcagcagggactgctcaaaaaagccaaagaaaaaggcaaaaacaaaaagtccaaagaagaaattcgtgacgaggaggagaacatcataaagaacattataaaaagtaaaatagatataaaggggggctatcagaaaccccaaatctgtgatcttctcctgtttcaaattatcttagctccttttcacctatgctcatatatagtttggtattgtcggtggatctataattttaacatcaaaggcaaagaatatggagaggaagagagattatacattatacgtaaatctatgaagatgtcaaagtctcaatttgatagtctagaagatcatcagaaagaaacttttcttaaacgagagctctggatcaaggagaattatgaggtctacaagcaagaacaagaggaagaattaaagaaaaagttggcaaatgaccccagatggaagagatacaggagatggatgaagaatgaagggcctgggcggttaacatttgtggatgactgaagattgatggaatgctactatgccaaaccttaattgtgatattattttcataactgaattattttagaaatgtatcaattgactgctgctcagcagtaactaaaattcctcaagtatttgattaaacagaataatgtcaaaatttaaaccttcccttaaaactttatacataagacatttatgattgttcaatttttataatctatttgtggattttgttaaaagatttcacatgaagatttattagttgccatttaaaatttttatatgtttagttaaaagatttgacatgaaaatttattagataccatttaaaaattttatgtgttatgtgtttattctttgagaatgttaccttactgtttgtaatagtgctacatttttctgctttcatggcctctgtattttcacaaaacaccaaaaacagcatttaattatattatcatgagtgtgtttctggacacaaacttctgcagtagaatgacctaacatgtcgttttcattgcagtcattataggattgaaatacgttcaaaataacctctctaggaaagtcttctgctagaatttctcccctctattcattataatattctttgtttttaaagccagtcaaatataatagtcttaataagatcagaaactctccaggagagtgagtctaccctcacgtccttgtaggatgatcttgattatagtcttattataggactataactgtattctcaacatttctccagaaaggaccttgtaaaaaggtcttttgtaccacagtattggttttttcccctctctcttcacttaaaaaaaaaaatagcaaggcagaaatagtgtattgaaaagttgttcatctattatgaagtccttgagtggtgaaaaatccgttgtacatgagaacatttctatgcatttaagccagaaacgaggtacatggctgtgtgctcttctgtcaaccaatgaaatgtgttttcacatgtgtggcagtgcaagtaaataacacattatttgactgaatcaggcatgatactgcaccaaagtgttggtacatattcacggtagtaaatcagtacccctgttaaaggatttatcccattgcttcatattaataaaatggttacaatatatcacaa

SEQ ID NO: 127697 - DNA, 2572 bp, Homo sapiens
  Payload ID: 4992
  Gene Symbol: DNAJC25
  Gene Name: DnaJ (Hsp40) homolog, subfamily C , member 25
  ENST ID: ENST00000463589
  CDS Start-End: 49-474
gagtgctgcagaatcgctggggtggcagagccgccagcgaggctggggatgggggcgccgctgctctctcccggctggggagccggggctgccggccggcgctggtggatgctgctggcgcccctgctgccggcgctgctgctggtgcggcccgcgggggccctggtggaggggctctactgcggcacgcgggactgctacgaggtgctgggcgtgagccgctcggcgggcaaggcggagatcgcgcgggcctaccgccagctggcccggcgctaccaccctgaccgctaccggccccagcccggagacgagggccccgggcggacgccgcagagcgccgaggaggctttcctgctggtggcaaccgcctacgagacactcaagatattggttatgttccagtcctcctgcatatgcccaagaggattgggagtggaatggacaccagcagaagcaccacagttattcctgtagagattagaaacaaggagcttattgccctgcttgtcaaggctcaggacagacaggaggaagaaacaagtataaaggttttggttttggaaagaagttggaatctccagaccctgggaccttaagatccacaaaattgctgaaagaaaaagtactaccttattgaaagattataaactaaggccatttaatggactgtcctatgaagttggatatcttgtcattttacaggatgaagaaacacgaaaagattatgattacatgctggatcatccagaagagtactacagccattactaccactactatagcaggcgcttggcccctaaggtggatgttagagtagtgattttggtcagcgtgtgtgctatttcggtgtttcagtttttcagctggtggaatagctacaataaggcaatcagctacctagccacagtgcccaagtaccgtatccaagctacagagattgccaagcagcagggactgctcaaaaaagccaaagaaaaaggcaaaaacaaaaagtccaaagaagaaattcgtgacgaggaggagaacatcataaagaacattataaaaagtaaaatagatataaaggggggctatcagaaaccccaaatctgtgatcttctcctgtttcaaattatcttagctccttttcacctatgctcatatatagtttggtattgtcggtggatctataattttaacatcaaaggcaaagaatatggagaggaagagagattatacattatacgtaaatctatgaagatgtcaaagtctcaatttgatagtctagaagatcatcagaaagaaacttttcttaaacgagagctctggatcaaggagaattatgaggtctacaagcaagaacaagaggaagaattaaagaaaaagttggcaaatgaccccagatggaagagatacaggagatggatgaagaatgaagggcctgggcggttaacatttgtggatgactgaagattgatggaatgctactatgccaaaccttaattgtgatattattttcataactgaattattttagaaatgtatcaattgactgctgctcagcagtaactaaaattcctcaagtatttgattaaacagaataatgtcaaaatttaaaccttcccttaaaactttatacataagacatttatgattgttcaatttttataatctatttgtggattttgttaaaagatttcacatgaagatttattagttgccatttaaaatttttatatgtttagttaaaagatttgacatgaaaatttattagataccatttaaaaattttatgtgttatgtgtttattctttgagaatgttaccttactgtttgtaatagtgctacatttttctgctttcatggcctctgtattttcacaaaacaccaaaaacagcatttaattatattatcatgagtgtgtttctggacacaaacttctgcagtagaatgacctaacatgtcgttttcattgcagtcattataggattgaaatacgttcaaaataacctctctaggaaagtcttctgctagaatttctcccctctattcattataatattctttgtttttaaagccagtcaaatataatagtcttaataagatcagaaactctccaggagagtgagtctaccctcacgtccttgtaggatgatcttgattatagtcttattataggactataactgtattctcaacatttctccagaaaggaccttgtaaaaaggtcttttgtaccacagtattggttttttcccctctctcttcacttaaaaaaaaaaatagcaaggcagaaatagtgtattgaaaagttgttcatctattatgaagtccttgagtggtgaaaaatccgttgtacatgagaacatttctatgcatttaagccagaaacgaggtacatggctgtgtgctcttctgtcaaccaatgaaatgtgttttcacatgtgtggcagtgcaagtaaataacacattatttgactgaatcaggcatgatactgcaccaaagtgttggtacatattcacggtagtaaatcagtacccctgttaaaggatttatcccattgcttcatattaataaaatggttacaatata

SEQ ID NO: 127698 - DNA, 2106 bp, Homo sapiens
  Payload ID: 4993
  Gene Symbol: DNAJC1
  Gene Name: DnaJ (Hsp40) homolog, subfamily C, member 1
  Uniprot ID: Q96KC8
  ENST ID: ENST00000376980
  CDS Start-End: 292-1956
gcagcccaggcgccgggcgctgcctctacagctgtgtgtaggcctgggggcgagggtcttcggaacgtagcgctggctgcggccccgcccgcctacccacccgcccgtccggcagccggctcccgccgcctccgcgctctgtctggggccagccacctggcgggccgctccggtgcgcctgcccgcgcttttcactgacaggcgctgttccccacagccagcgccgcccgccacgtcccagctctcggccaacggagctgcgcggcgggtgacctttccgagcccagcgcgatgacggctccttgctcccagccggcgcagcttcctggacgccgccagctcgggctggtgccgttcccgccgccgccgccgcggacgccgctgctgtggctgctgctgctgctgctggccgccgtggcgccggcgcgcggctgggagagcggagacctggagttgtttgacttagtggaggaggtgcagctcaacttctaccagttcctcggggtgcagcaggatgcatcatctgcagacatcagaaaagcatatcgtaagctttcactaactttacatccagacaagaataaagatgaaaatgcagaaactcagtttagacaattggtggccatttatgaagttttaaaggatgatgaacgaaggcagaggtatgatgatattctgatcaatggacttccagattggcgacagcctgtattctactacaggcgggtgagaaaaatgagcaatgctgagctggcattactcttgttcattattctcacagtgggtcattatgctgtggtttggtcaatctacctggaaaaacaactggatgaactactaagtagaaaaaagagagaaaagaaaaaaaagactggcagcaagagtgtggatgtatcaaaactcggtgcttcagaaaaaaatgaaagattgctgatgaaaccacagtggcatgatttgcttccatgcaaactggggatttggttttgccttacactaaaagcattacctcacctcatccaggatgctgggcagttttatgctaaatataaagaaacaagattgaaggaaaaggaagatgcactgactagaactgaacttgaaacacttcaaaaacagaagaaagttaaaaaaccaaaacctgaatttcctgtatacacacctttagaaactacatatattcagtcttatgatcatggaacttccatagaagaaattgaggaacaaatggatgattggttggaaaacaggaaccgaacacagaaaaaacaggcacctgaatggacagaagaggacctcagccaactgacaagaagtatggttaagttcccaggagggactccaggtcgatgggaaaagattgcccacgaattgggtcgatctgtgacagatgtgacaaccaaagccaagcaactgaaggattcagtgacctgctccccaggaatggttagactctccgaactcaaatcgacagttcagaattccaggcccatcaaaacggccaccaccttgcccgatgacatgatcacccagcgagaggacgcagagggggtggcagcggaggaggagcaggagggagactccggtgagcaggagaccggggccactgatgcccggcctcggaggcggaagccagccaggctgctggaggctacagcgaagccggagccagaggagaagtccagagccaagcggcagaaggactttgacatagcagaacaaaacgagtccagcgacgaggagagcctgagaaaagagagagctcggtctgcagaggagccgtggactcaaaatcaacagaaacttctggaactggcgttgcagcagtacccaaggggatcctctgaccgctgggacaaaatagccagatgtgtcccgtccaagagcaaggaagactgtatcgctaggtacaagttgctggttgaactggtccaaaagaaaaaacaagctaaaagctgaatattctgggagatgatgttcaccttcattttccaaaatgaatatcttaaaaatcttatgcagaaatttgcattttgtacctcaatatttctacgtcatgtgccttagtaaaaaaaaataataaataaataaaagatgagtgttgtgcta

SEQ ID NO: 127699 - DNA, 682 bp, Homo sapiens
  Payload ID: 4993
  Gene Symbol: DNAJC1
  Gene Name: DnaJ (Hsp40) homolog, subfamily C, member 1
  ENST ID: ENST00000476103
  CDS Start-End: 152-481
gtctggggccagccacctggcgggccgctccggtgcgcctgcccgcgcttttcactgacaggcgctgttccccacagccagcgccgcccgccacgtcccagctctcggccaacggagctgcgcggcgggtgacctttccgagcccagcgcgatgacggctccttgctcccagccggcgcagcttcctggacgccgccagctcgggctggtgccgttcccgccgccgccgccgcggacgccgctgctgtggctgctgctgctgctgctggccgccgtggcgccggcgcgcggctgggagagcggagacctggagttgtttgacttagtggaggaggtgcagctcaacttctaccagttcctcggggtgcagcaggatgcatcatctgcagacatcagaaaagcatatcgtaagctttcactaactttacatccagacaagaataaagatgaaaatgcagaaactcagtttagacaagtatgatgatattctgatcaatggacttccagattggcgacagcctgtattctactacaggcgggtgagaaaaatgagcaatgctgagctggcattactcttgttcattattctcacagtgggtcattatgctgtggtttggtcaatctacctggaaaaacaactggatgaactactaagtagaaaaaagagagaaaagaaaaaaaa

SEQ ID NO: 127700 - DNA, 20129 bp, Homo sapiens
  Payload ID: 4994
  Gene Symbol: DNAJC10
  Gene Name: DnaJ (Hsp40) homolog, subfamily C, member 10
  Uniprot ID: Q8IXB1
  ENST ID: ENST00000264065
  CDS Start-End: 416-2797
agaccggcgcgtgaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagcctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttggatggtcttgttaatgtaggatggatggactgtgccacccaggataacctttgtaaaagcttagatattacaacaagtactactgcttattttcctcctggagccactttaaataacaaagagaaaaacagtattttgtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcattatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaaattttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgccgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcgtagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaacctgttagaatatgctttattgtgttttgaggagttttcctttttttcttttcaatatcactttatcctgctcaccagtatttcctcataagggttattatagccataattaatgttaaaatagactttgttcttcatattctcccatctttttcgctactatatactctgtctggattctgctgtatgcctgttggcatatatggaacagtcaccacttgtcacacttaacaccagctttttgaattatgatcagtaatggcaagagcctttcattctcgaatgtttaaagcctaggagttctacaaaattggcttctttctacaagaatcccaaaatggaatgcctaaagaagtcttacttgggtaaatacttactaaaatatactggttatgtgcatatcaccacactggacactgaggagtgttcaaaaggaatctaagacatggtccccatcttccaactgtctgtaattcactgttttgtcattgagctcataaggtacttacattactacctataaatgtttcctgtacttgttagttgttgagaaacattttaggcagtaaataaaatagtaaatattatgtgtcctataatttgacctaagctgtgtgcctttggaatcagctctaagccagggccccctgggagtcatgttaagaaacacgtatcataaagtgacatacatcaaggttatcttatatagtcataacagtattattgggtctttcaaaaacagctggcagattgagcttttaatggctatattgatacagtagatagagcacctctaaggagtaccaggtataatgtgccatttctctcagcaacaccatttttgtgtgcagctgaccctctaacatggtatcaattctagctgaccaaagcacattctatcaggcagccaggcttggaaattaggtccatttaaagtatgtggcttacagtcaggtatggtggtgtgcgcctattgtcccatctacttgagaggctgaggcaggagggattgcttgggctcaggattttgaatccagcctgggcaacatagcaagaccccatctctaataaataaattatgttttgggcattaatgatgtttgtctattctgatttctcaaattttatttaggtctttcatagcttttttatttaaaggtatatgattaagataaaggaaaagtaaaatgaaatgtttatgtaattttatattctcaaaattttctttaaatttgctctgttttctgacagtgctcaaagtgggaatttttttagaagtacggttatcaaaaaaacacatttcctatgggacacacatttcaaagatgtttagtacgataaaatttttagtaaaagggtagcacttttaagtcatttgaatagaatatttgtgtaatatttagtctagtgttagtccttaaatctgccaacaaaaccagatagatgtcttaaagtaggcacatttattccattgtgactgttaagaaataataaaagattaaattaacaaaatgcattttaaatttttatgatacctatagaaaattgataatgaagatgaaaagtaaataacctttctgataatattctactttacacatatactgaaaacttacttacatatacccaaattcttctagtgaagaagtttgtaatatggtttgagtatttgtcccctccaaatctcatgttgaaatatgatccccagtgttggatatggggcctggtgggaggtgtttgggtgatgggggctgatccctcataaatggctttgtgccttccccagtggtaatgagttcctgctgtgtttattcctgcaagagctggttgttaaaaggaacttggcaccaccacctcctctctttctcgctccttctctgtgtgacatgccttctccccccgtgccttctgccatgagtaaaagctccctgagacctcaccagaagctgagcagatgctggtgccatgtttttacagcctgcagaactgcaagtcaaataaacgttttctttataaggtaaccagtcccaggtattccttcattgcaatgcaaaacagactaatacagtttcttttcagtaagaattacaaaatttaggccaatgaccaagctgagtataaattactaatcatacacaaaaatgtgtttcactggcttgagtcatttttctgtttaacactgaatttacacttagattcttgtactgtcactgagtccccttgtaaacagctaggtatattttgtgaatggaaactagccaaaaatacagccaaagtctcaacgccaaactggtctacatcagtatggactccagaaatgcatctttcaaccacttgattgcattaagtagtcatttgagtgcatcacctagtggcctttggtcctgaaagttagcaatcatccccaaaaaggtctgtgttaataactgatagacaatcttcattaagcaactgctgttttttttttttaatacttcaagttctgcaatacatgtgcagaacatgcaggtttgttacataggtatacatgtgccatggtggtttgctgcacccatcaacctgtcatctacattagctatttcttctaatgttgtccttccccttgccccctaccccgccgacaggccccattgttgatgttcccctccctgtgtccatatgttctcattgttcaactcccacttacgagtgacaacatgtggtgtttggttttctgttcctgttagtttgctgagaataatggtttccggcttcatccctgtccctgcaaaggacatgaacgcatccttttttatggctgcatagtattccatggtgtgtttgtgcccgtttctttatccagtctaacattgatgggcattttggttggttccaagtgtttcctattgtgaatagtgctccaataaacatacgtgtgcatgtgtctttatagtaaaattatttataatcctttaggtatatacccagtaacgggattgctgggtcaaatggtatttctatttctagatccttgaggaatcgccacactgtcttccacaatggttgaacaaatttacactcccactaacagtgtaaaagcattcctatttctccacatcctctccagcatctgttgtttcctcactttttaatgatcgccattctaactgatgtgacatggtatctcattgtgtttttgatttgcatttctctaatgaccactgatgatgagctttttttcatatctttgttggccacctaaatgtcttcttttgagaagtgtctgttcatatcctttgcccacttttaatgggatttttttcttgtaaatttaagttccttgtagattctggatattagccctttgtcagatggatagattgcaaaaagtttctcccattctgtaggttgcctgttcactctgatcatagtttcttttgccatgcagaagctctttaattagatcccatttatctgttttggcttttattgccattgcttttggtgttctagtcatgaagtctttgcccatgcctatgtcctgaatggtgttgcctaggttttcttctaggttttttatggtttcagaccttacatttaagtctttaatctatcaacttaatttttatataaggtgtaaggaaggggtcccagtttcagttttctacatgtggctagcctgttttcccaacatcatttattaaatagggaatcctttccccattgcttgtttttgtcaggtttgtcaaagatcagatggttgtagaagtgtggcgttatttctgagggctgtgttctgttccattggtctatagctctgttttggtaccagtaccatgctgttttggttactgagccttgtagtatagttcgttctttttgcttaggattgccttggctatatgggctcttttttttttggttccatatgaaatttaaagtagttttttccaattctgtgaagaaagtcaatggtagcttgatgggaatagcattgaatctataaattactttgggcagtatgactatttcacaatattaattcttcctatccatgagcatggaatgctttttccatttgtttctgtcctctctcatttccttgagcagtggtttgtagttcttgaagaggtccttcacgtcccttgtaagttgtattcctaggtatttaattctctttgtagcaattgtgaatgggagttcactcacgatttggctctctgtttgtcaattattggtgtataggaatgcttgtgatttttgcacattaattttgtatcctgagactttgctgaagttgcttatcagcttaaggagtttttgggctgagatgatggggttttctaaatatacaattatgtcatctgcaaacagagataatttgacttcctctcttcctgtttgaatacgctttctttctcttgcctgattgtcctggccagaacttccagtacataggagtggtgagagagggcatccttgtcttgtgccggttttcaaagggaatgcttgcagcttttgcccattcagtatgatattggctgtggttttgtcataaatagctcttattattttgagatatgttccatcatatctagttttttgagtgtttttagcatgaaagggtgttaattttatcgaaggccttttctgcatctattgagataatcatgtttttgtcataactgctatttcaaatgtttggaggaagtaaaatgtctttaaaagaataagtgttgatttttggaaaatatgaaattggaaacttagaaaacttgaattctaagtggctatttatattaccaagcggtaaaacattagctaactaaaacatggttctgaagccagttaactagcaaaaagtcccacctatgcattgaaatatctttctcaagtcattagataaagtatatggcgttaaggcaaaaaatacatatacacacacaaaaaaaatatttcagcagccactgccaactgaaagtaataaaatgaaacaatttgttggctttaatgtatttaggaaaaatcatttatttacaaaacatcttccctttcttatcatgaaaattatgaagatgaggtaaagtctgttccatttttcctctatttttgagaaatcttagatttatctttaccagtctgtaacccagctttcttgttttatattttaaatatactttctattttgtgacaggagtgaaaaaatgtttaatgattttaaacatgtttatatatatttttcagacttggaacagcagtatctcatgttttactataaaaacttgggtatattacttgaagatcaactatattgttatttttagtatgttagcaattcatctgtcaataatcaccaaagaactcaagaatgaataacatgatctatcaaaaggcctataatctcaatcttcatgttaagactttggaaagttaatttgtattaattaactaatataaattaatcctatcaagttaatttgtaataaattcaagatgcaaaaagaaaacctatttcactaccgaaattaaataaactttaaaattcattttgttggctgggtgcagtagctcacgcccataatcccagcactttgggaggccaagtggaaggatcacttaaggccaggagttcaagaccagcctagccaacatagtgaaaccccatctctactaaaaatacaaaaactagctgggcatggaggtgtgtgcctgtaatcatctaccctggaggctgagacaggagaattgcatgaacccggaggcaaaggttgcagtgagcagagatcacaccactgccctccagcctgggtgacggagtaagaccctgtctaaaaaaaaacaaaacaacaaaaaaaatcattttgttggtattttatataaacttaagaaacctccccacacaaacacacacagccatattgtcatctctgaagacagcagccacatgtgtcttattccctgcagtgttggcagaacctagcacattgttgacccgtagaagcacagtgtgtatttcaattgacaaacagccagaagtattatactgttgactgtgtttaaaactaatttgccagagctctactgtgataagaatttctgactagaaattataaattcattgttttatgccttaaaaattataaataatgataagtttaatttgcagcccttatagcttagaggcattgtagttgatattatagtaacccttttagatgttagtaacttttattgtaaaatttaaggtagctctacctgctaaagtagcacctattcttttgaaaggaactttctcaaaggatttttagggcttcataatttcttgttgctctgtgtaaatccctctgataggcttccctgaaggattttaagcagaaataacatcaggtaccagtagatggcagtgaaaaataagcagacacatttttctgataaaatgccatttctacctcagtacttgataagaatcacacagtctagctggcctttgtgttttcactaaaaatatcctgaattatcagtcagttatgtttgactatgagaaattgcagaaaagttaaaagtatttcgcatccaaaagtttgtaatctagtgtaataaataggacagatactcaaagtgtatgaatggtatgacaataaatttagaaaatcatacaggcacacacactgctatagacatgtaaagatacatacatgtattggagctcagcagattcccattcatgaagaatggtgcctgtgtaacagtataaatggatcacttctaataaataaaacataaaattggactaatagcttaatttttttttttaattcaaaaatctcagggttttctggggcttttagtactcctttgtgaaataagacacatagtcttcaggtaaaaagaaagagctcttggtcacagaaatgggtgtactgaattctcgccctgtagtcaagtacttactatgagtttggaaaaattgcttacttcatatctgtatcctaattatcctaattaactcgtttgttaagtggaaaaaatatttcagtaggtagtcatataaataagatgaggtaatgtgtttagaaaaacaaatcaatgtgcaggcaagaatcgggaatgtgggaaattttgtaggacaaatggtatgatttctttaatgaaaaagacagagaaaggtatcgtatagcttaaaaggaaaaagaaaaagaggcttttcagtcatgagccaaatgcagtatgtgggctatatttgcatcttgatttgaacagactattgtatacatttatatatacatagatctatagagacagtaggatatatttcatatatatatgaaacagttggggaaatcagaatatttgaatttgatattaactaagaattgtttgcaggggatgttgttgcatattctaatgactttttttaataatgaaaatgtttggcatttgctttaaaataatccagtaaccaggatctgagagaaaccaaaaaaaagtggggagataataatccagggactttgggtagttgttaaatggatggctgtatcataagtattgaagctgataagggatagatatgggttgattatatatttgttttgctggaaaatgttccatgatacagttttaataacagttttaatttcagaaacgcaaaatattgtttttacaactaagataacattgaaatttatacagaaccccaaatgacaagtgtataatcaactgccaggaaatcagtttacctgttagaggtagaaaagttacaggataaaaatggaattggttggcactaagtaggaccactttcgaagagaatgggtagaattcattttcttttcattacttcctttcagcgtggagcctgagcatcatttcaccattttgagcctcaagctctcaatatactggaaaattgtaatcctgttcccttcactgaggtcataatactgaattctgaaatggaaataattgactagagattgtctagtcaaactagactgatgaggtctcaccattttcttcaaggaagatcaactgaacctgcctgaaggcacagggtacaccatcttcctaaggtgtgacctcctgttcccaaaggaatagacctaggtgaccaaccagcagcacctagcttttgccagctacgcagctttgaatagccttccacccttgtgtccttcaaaccccattcttgccaaagccaagttctctccctccctctcaacagatttctcagcacacatcagatttcacaccgatctatgaaaaactatttttagagattattactatggtccgaatgtttatatcccctcctgctctccctaaaattatgttgaaatcctaacccccaaggtaatggtattaggaatgtgaggcctttgggaagggtttaagtcatgagggcagagacctcctttttgagattggtacacttataaaagagaccccagtatcttgctcgtcccttctgccatgggagaacacggtgagagcgagccatctgtaaaccaacaaacaaggccctcaccaggcactcaatctgccagcactttgatagtggacttcccagcctccagaactatgagaaataaatgtgtttttttaagccagccagttcattttgttatagcagcctggacagacaatatattgaaaaaaatcagttttgcagttccactggtcaggtgaatgccagaggagctggtccacagtcataggcgttaaacttcttttggaaactatactggcttgacagtctccccatactgattcagactccagcaaggtgcacatcacccgctagtcattgtggcttctgctgctttaaggttctggaattatggaagaaaatagggtgggcctactgtctcttcccactgtttacctggtgttttgattctgaatagtttataagctctgctattcaagaagtttatacaaacccgtaatgtactaccaaaccgttcattcattatgacaaaactgcctaccaaagccacagactttaagtctttgcaggattaccactgaaagttcacatgcttggttagcagtcttaacctctaaccaactgaacaaatcgaagacatttaatttagtcaaaataggcatgggaatgaaagtgagacttagaggcaaagaatgaggccaggtgcggtggctcacacctgtaactccagcactttggaaggcccaggcagaaggattcctgcagaccaggatttcaagaccagcctggacaacctggtgaaacctcctctctacaagaaaattcaaaaattagccaggcgtggtagggtatgcctgtagtcccagctacttgggaggctgaggtgggaggactgcttgagcccaggaggtccaggctgcagtgagccgtgatcacaccactgcactccagactgggaggcagaggaagaccccgtctcaaaaaacaaaaggtaaagaatgattttaggaattaggtgtctctaaattgaagtaatgctcacatagaaaaattaaggcatattattttactgtactctcagaaagatgtttaacaaatacttgaagagccactatttaagataaatgagagtcctttccaatttgagcctcgcagagtggttcctacagagaagggtggcaagaagggctgttctgccatcaatgaggtggtgacccgagaatatgccatcagcgtccacaagcccatccatggagtgggattcaagaagcatacccctcagagcactcaaagagatccggaagtgtgccacaaaggaaatgcgcgttgataccagcctctacaaagctgtcggggccaggcgaataaaggatgtcccatgtcttatccataagcagtagtccagaaaacatagcgaggatgaaaattcaccaaacgagctcttatactttggttacctatgtacctgttaccacttgcagaaatcaacagacaaggtggatgagaactgtaaatcatcaaataagttataaaaccaccaaaaaataggagaaaatgggagtaaaaacaaaatgtataaaaagtattaaaatttgaaaaatatcttggaaataaggatggacagtttaagtacttatctcaaaaggaaaaatgttagcaattggttgtagcaatacgtccgtctgtaagtgatggtcatatttgtgttcttttgtcccagagaacaaaaggaagtgagcttatcccacagcacaagtaacgtctatttatctcagaggaaatccagggaagttcctacttgggaaaacggaaaggtagactattcagaagttttctaaaatggacttcaagctctatgactttatgatcacttagtatgtctacggattttttggggaagagagatttcacgttaaaggtcattttgtgtcttctttaaaactcttgattccttttagagttttttaaattgtgataaagtacatgtaacaaaatttattaatcattttaaagtagcatacagttcagtagtgttaagtaatttcacattgttcaacccatctccgtgactttatcttgcaaaactgaaattttatatccataaagcaaaacctttttatttaccaatgctgctagaccctgacaaccaccaccctactttctatcaatatgactaccatagatatttaatgtaagtgaaatcatacaccatttatctttttgtgattccttattttacttagcgtaagtcctcgagactcacccatgttgtagcatgtgtcataattttcttgttttgagacggagtcttactctgtccccctggctggagtgcagtggtgtgatctcagctcactgcaacctccacctcccaggttcaagcgattctcctgcctcaccctcccaagtagctgggactgcaggcatgtgccaccacgctggctaatttttgtatgtttaacggagacaaggttttagtgtgttggccaggctggtctcgaactcttgacctcaggtgatccgcctgccttggtctcccaaagtgctgggattacaggcgtgagccaccgcacccagccaattttcttcctttttaaggctgaataatattcaattatatatacattctacattttgttattcgtccgttgataggctgccttcaccctttggccattgcaaataatgctgctataaacatgggtgtacaaatatcagaaaccctgctttcagttctttcagctatatacctagaagtgtaagtctatatcatagtaattctatttttaatatggggggacctccatactgtttttcatagcagctgcaccattttacattcccaccaatagtgcacaagagttctgatttttccacatcctcaccaacactcattttttttaaatagtaggtatcccaatgagtgtgcgttcatatcccattggagttttgatttgtacttttagagtctttaaattattactttttccatatcaaagtactttgtgggaagttggttattttacattctcataccatgctttgtattactttcccatttggatgcccttttcatccttcacctcatcctgtaaacccaaaatctaacttaaatcccaaatccaacttccactgtaaagcctttgctgacttctttacttcacattgatttctgaatttctaaaagttcctcattgtctaccacaaaactaagtatttgtttataagaaaaagctttatttagtcctatattattctctgattattccatatgttatcttccaaactagattgttaggtcttcaagagcagaagaaatttattttatacttataaacttcaagatttgctgaagtactttgggtgctaaatgcttctagcttattcgtttagtttacatgactttctgcatgtgaaacttgagaaaactgcaaatctaataccttggtcttacagaactgaacaatacttaaatgtgtttaaacctgctatataaaatgtcagatgtaaaagcgaatatctaatgaagcaccttttcccttttctaaaattcaatagtaagggccaggcacagtggctcacacctgaaatcccagcgctttgggaggccgaggcgggtggatcccttgaggttaagagttcaagaccagcctggccaacatggtgaaacgccgtctctactaaaaatacaaaaaaaaatggccaggcgtggtggtgcacgcctgtaatcccagctacttgggagtctgagacaggaaaatcgcttgaacccgggaggcagaggttacagtgagctgaggtcacgtcactgtactccagcctgggcaacaagagtgaaactctatctcaaaaaaaaaaaaaaaaattacaatagtaataattatgccttctaacactaaaatcaaataaccttacttatcagttacattgcctactaagctgacttattttctgacttttcctttgctttattctcttatttcttccaagtaaccatattctcttttaccctcctgttcaactgtctatgctccttctctctttgttcactattttgatatttaaatgttatgacttattttcaagtaaatatttttttaatttcttcatttgggataaaatattcactacataaatttagtggataaatacccccacagagatcgaccctgcatgaaatgtgttccctcagaagtagggcaattcattcattatgagatcaagccataaaatttaaatccaagcagtaattctccaattaaagtaactctagagcttagttttcagtcctcctgaatcataactagttggcaacaaaaactagtatgccttggtgtgaataaaccttaacatagaaactcacccagcctcaaaagttaaaaattaagagagatatgtattcaggtggccatttatacacaatatttttgaatactattctggccaaattagtataaaatgggttactctaaaatgaaattttaaaagtatataaacatcttaaactttaaaacttcagcccagctagaagtcaacgtgtgtttctgaaactatgctggggaaagtagctctgtccataatgattatatagttgttagcaaaatattggtcaaaactttttcagtttaatgagtttcaagatattcttcaaactggcctctgtgaactctttcttgacaagtgaaacctggctccaacaatgactactttattctacctctcatttattttctgtttaataaatccagtatttgggcatacaaactgtatacaacattttataacactctaatgtggataagacacctcaaaaacaggagtttagtcatttcagtcacatgtttctaatacatgataagatttgcagttatcgtttaattaattgcaatatggaaatagatactaaaaaatctaaattgcatcttacatttcaacaatggatgtttaaagcgtttaaaagttatgttttgcattttacaacatattgaagatacacattttaaatttaactctaaacaatgcaataatctagagaatcagagaattggatcctgaaacaccttataagttcagtcctgttgattagtatgtttccctgtcctagagtgcatgaactttcaaagccaggacacaatcttgttcacttttcatgccatcatcttgacactcaatacatgttcaaagagtaaattaaagaaaaaagagatgctcaagtcaatttataagtaatcctcacaaatgcttgcataccatcagtgaacaattatttttttatctccatgctataatcttgcacaagtttcattagaattaaatgcactatctgaagtctatgtttattaaatgaggattacagtagttggttatctttgtgaggggttttgagggttgtggaacaggataacattttgaggtacaaaaaataatgaagaggatatattccaatttctttccttccccaaggcttttcattacagctgttataaaccctggtagaattgattggtttccttttcagcttcctgttttgtccctcaatgttcacaaaagtcccatctgataaatgtattgtttaacctctcattgtttgaaagaacacctctttgctccccacagattacagacctattggcttaagcagtccatctaaatgcatgccagtttctttcttgataaattagaggcctataacctcaaaccagtttatctgcaagagaagtgtgtgaagttagactcaattcttccgctaatggaacatcgtaatcctccttgtcatctttcctttggccttcctgaatagaaatcatttatgaggaagttacatgagctcaacatgagccccatgtcactcagcaaacatttatttgagtacttacaatgtgctaggctttgttctatgcatttaagatagtgtattaaatgtattgacctcatgaagattctattctcgcagtggggagatagacaataaacaattaatataagcaaatgttaagtatgttagaagtatgttagaagatgtgctgtgaaataaagaaaaaggtagaccagggtatgagggattaggagtgtgggggcagcagcaggagagtttcggtattaaatagggtggacagggcaggtctcttggagaagatgccattgaaggaggtggaaaaaatgtagccactaaatgggctgagggtagagcatatgaacagagagaaaggccagaggacaggctccaaggcatgcttggcaggttcaaggaacagcagggaggctcatgtggctggaatggagtgagctagcaggagagaagatgaagttagagggagagagaaagtggggagccagatcatagagggctttgcaggtcacttgtaaggactttagctttctaacttttgtaaggacttcaacttctactcacagtgaaattgtgaaattccagaaccaaaaagaagatcctggtaaaagagaaactttcagcaaaatatatttaacattttatttgagtgaagaacaattcatccatcaggcagcactgagaaccagaagacattcagagagctctgctttgcgaggtatgcagtgaacattcatagacagaaaacaaaaattaagtacagaaatagcttgattggttacagataggcatttgccttatttggacatggtctgctccaaataaggcaagttggcagcatgcaattggctgtgacctatctgttacaaaaatatatctatataatcctaaattaggtttcagtttatttaagtactaaattaggttgcaatttattacatgggaactcaaagtctggagacagcctcaggccaaggtcctcttgcttatttaatttagcaatcctaaaattttccagagaggaaacacatcacacacacacacacacacacacacacacacacacacacacacactacctacaaaaaaataacaattagaaagtaattggagcttgaagtattctagaagactttggagcaaagccttccaaattctgagaggaaaatatttttaacctaggattctattcatacctacccagactaacaagtagcaggcagatgataaatatatttttaggtggttaggtgatgaaacacctcctccaaatgaaggcataaacaacaatgcatggggatccaagaaacagtgactccaacccaagagagcagtgaacaaatccacaggacagcagctaagtaggaggcctaaacatcacctggggcagatggggcgagagagcagagagcttgggaaagaagtctctgaggagaaagaatgaggcaataagtcagatgcgtatttgcggacctcagaaaaatttgagtacataggaaacaatagatgaaggatagaaataatccattcagattctctcctttgcatgatgaccacattaaacttacagagtaagaaatgtcattctagatttgattctactgtttgtctttgcagtgagctatgtttttttataacatgtagaagtgaaataaacttgtcacaaaaatgcaaa

SEQ ID NO: 127701 - DNA, 2988 bp, Homo sapiens
  Payload ID: 4994
  Gene Symbol: DNAJC10
  Gene Name: DnaJ (Hsp40) homolog, subfamily C, member 10
  ENST ID: ENST00000418559
  CDS Start-End: 1-828
atgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagcctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtatatttgctggaaagaagttaaaacaatgaacaagccttttgaaatctttgtttaaatgaaattattttctcagtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcattatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaaattttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgc

SEQ ID NO: 127702 - DNA, 605 bp, Homo sapiens
  Payload ID: 4994
  Gene Symbol: DNAJC10
  Gene Name: DnaJ (Hsp40) homolog, subfamily C, member 10
  ENST ID: ENST00000444005
  CDS Start-End: 1-366
gccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttggatggtcttgttaatgtaggatggatggactgtgccacccaggataacctttgtaaaagcttagatattacaacaagtactactgcttattttcctcctggagccactttaaataacaaagagaaaaacagtattttgctgcttcattgagagaatcagaccagcagagagagagagttatatgacaaaatatgctgaggataaaatattgacaaataaagaagatttgttagaagggccttttatactcgtttgtgttttaaataagagactcgggccgaaaacaagtttaagataagatcttttctcaactcattggatgctaaagaaatatatttggaagtaatacataatcttccagattttgaactactttcggcaaacacact

SEQ ID NO: 127703 - DNA, 1669 bp, Homo sapiens
  Payload ID: 4994
  Gene Symbol: DNAJC10
  Gene Name: DnaJ (Hsp40) homolog, subfamily C, member 10
  Uniprot ID: Q8IXB1
  ENST ID: ENST00000537515
  CDS Start-End: 21-1019
gaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagcctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttggatggtcttgttaatgtaggatggatggactgtgccacccaggataacctttgtaaaagcttagatattacaacaagtactactgcttattttcctcctggagccactttaaataacaaagagaaaaacagtattttgctgcttcattgagagaatcagaccagcagagagagagagttatatgacaaaatatgctgaggataaaatattgacaaataaagaagatttgttagaagggccttttatactcgtttgtgttttaaataagagactcgggccgaaaacaagtttaagataagatctgtatcattgtattttactctaaaaactcctaagtggtttggtttttagatgaaaacctctataatgagcaaaagtccattccaattttccacttctaagttcctcttaattaatcttaattattggttggggaatgaagtgtctttgatagtctattattcttccttctagtgttataaaaattcttaagtgaatgtgtaaaacattggcattctgtaaaacatgattagcattaaaattaagctaaagataatgtggtttttcttgatgattgggaggtcactcaggatttttctgagcatttttatagaatacacatcatagttaattaaaaattccagttaatgcaacatcttataatggaatttattgtatatcactatttaagaaacagcttagttatataatatttttgataattgccaaaatacactttttttgaaaaaagacatttggaattgtttgaaaaactatttaccttctataatcattttcct

SEQ ID NO: 127704 - DNA, 5783 bp, Homo sapiens
  Payload ID: 4994
  Gene Symbol: DNAJC10
  Gene Name: DnaJ (Hsp40) homolog, subfamily C, member 10
  Uniprot ID: Q8IXB1
  ENST ID: ENST00000616986
  CDS Start-End: 647-2890
gcattggtgagggggcgcgggctgcttggccagggcagttccctcagctccgggttggagccggagccggagccggatcccgcgcacaccgccacgtcaacctaaacctacaccgccctctccaccccaccgccgcagcgcccgctgggcccgcagcgggtctccccaggcagcgtcctccacgcctttcccacaatgctccgcgccaggccccgccccggctcgccgtggagaccggcgcgtgaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtatatttttgtggaatgaaaaggaagtattagaaatgagctgaagaccattcacagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaagtggatgggttacttcgaattggagctgttaactgtggtgatgatagaatgctttgccgaatgaaaggagtcaacagctatcccagcctcttcatttttcggtctggaatggccccagtgaaatatcatggagacagatcaaaggagagtttagtgagttttgcaatgcagcatgttagaagtacagtgacagaactttggacaggaaattttgtcaactccatacaaactgcttttgctgctggtattggctggctgatcactttttgttcaaaaggaggagattgtttgacttcacagacacgactcaggcttagtggcatgttgtttctcaactcattggatgctaaagaaatatatttggaagtaatacataatcttccagattttgaactactttcggcaaacacactagaggatcgtttggctcatcatcggtggctgttattttttcattttggaaaaaatgaaaattcaaatgatcctgagctgaaaaaactaaaaactctacttaaaaatgatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccggacattaactggactgatcaacgtgggcagtatagattgccaacagtatcattctttttgtgcccaggaaaacgttcaaagataccctgagataagattttttcccccaaaatcaaataaagcttatcattatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaaattttatttctacgaaagagcaaagagaaattttcaagaagagcagataaataccagagatgcaaaagcaatcgctgccttaataagtgaaaaattggaaactctccgaaatcaaggcaagaggaataaggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgccgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcgtagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaacctgttagaatatgctttattgtgttttgaggagttttcctttttttcttttcaatatcactttatcctgctcaccagtatttcctcataagggttattatagccataattaatgttaaaatagactttgttcttcatattctcccatctttttcgctactatatactctgtctggattctgctgtatgcctgttggcatatatggaacagtcaccacttgtcacacttaacaccagctttttgaattatgatcagtaatggcaagagcctttcattctcgaatgtttaaagcctaggagttctacaaaattggcttctttctacaagaatcccaaaatggaatgcctaaagaagtcttacttgggtaaatacttactaaaatatactggttatgtgcatatcaccacactggacactgaggagtgttcaaaaggaatctaagacatggtccccatcttccaactgtctgtaattcactgttttgtcattgagctcataaggtacttacattactacctataaatgtttcctgtacttgttagttgttgagaaacattttaggcagtaaataaaatagtaaatattatgtgtcctataatttgacctaagctgtgtgcctttggaatcagctctaagccagggccccctgggagtcatgttaagaaacacgtatcataaagtgacatacatcaaggttatcttatatagtcataacagtattattgggtctttcaaaaacagctggcagattgagcttttaatggctatattgatacagtagatagagcacctctaaggagtaccaggtataatgtgccatttctctcagcaacaccatttttgtgtgcagctgaccctctaacatggtatcaattctagctgaccaaagcacattctatcaggcagccaggcttggaaattaggtccatttaaagtatgtggcttacagtcaggtatggtggtgtgcgcctattgtcccatctacttgagaggctgaggcaggagggattgcttgggctcaggattttgaatccagcctgggcaacatagcaagaccccatctctaataaataaattatgttttgggcattaatgatgtttgtctattctgatttctcaaattttatttaggtctttcatagcttttttatttaaaggtatatgattaagataaaggaaaagtaaaatgaaatgtttatgtaattttatattctcaaaattttctttaaatttgctctgttttctgacagtgctcaaagtgggaatttttttagaagtacggttatcaaaaaaacacatttcctatgggacacacatttcaaagatgtttagtacgataaaatttttagtaaaagggtagcacttttaagtcatttgaatagaatatttgtgtaatatttagtctagtgttagtccttaaatctgccaacaaaaccagatagatgtcttaaagtaggcacatttattccattgtgactgttaagaaataataaaagattaaattaacaaaa

SEQ ID NO: 127705 - DNA, 1010 bp, Homo sapiens
  Payload ID: 4994
  Gene Symbol: DNAJC10
  Gene Name: DnaJ (Hsp40) homolog, subfamily C, member 10
  ENST ID: ENST00000613960
  CDS Start-End: 1-534
atgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccgaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtatttatgatgatgatcctgaaatcataacattggaaagaagagaatttgatgctgctgttaattctggagaactgtggtttgtaaatttttactccccaggctgttcacactgccatgatttagctcccacatggagagactttgctaaagaaaccctgagataagattttttcccccaaaatcaaataaagcttatcattatcacagttacaatggttggaatagggatgcttattccctgagaatctggggtctaggatttttacctcaagtatccacagatctaacacctcagactttcagtgaaaaagttctacaagggaaaaatcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaaattttatttctacgaaagagcaaagagaaattttcaagaagagcagataaataccagagatgcaaaagcaatcgctgccttaataagtgaaaaattggaaactctccgaaatcaaggcaagaggaataaggtatggact

SEQ ID NO: 127706 - DNA, 2210 bp, Homo sapiens
  Payload ID: 4995
  Gene Symbol: DNAJC11
  Gene Name: DnaJ (Hsp40) homolog, subfamily C, member 11
  Uniprot ID: Q9NVH1
  ENST ID: ENST00000294401
  CDS Start-End: 125-1648
gacggctccgggccgccaggggccgctgtggcgcagccgggctggcccgcgctgtccctgacgcggatcactggcccctcttgagcacggccttgccggtttggcggggtgaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggtgtttctctcaaagtcaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcttgctgaaatattactgcttgaatctggagcagattgcgggtttataaaactgctttttatctgagaacaaa

SEQ ID NO: 127707 - DNA, 3311 bp, Homo sapiens
  Payload ID: 4995
  Gene Symbol: DNAJC11
  Gene Name: DnaJ (Hsp40) homolog, subfamily C, member 11
  Uniprot ID: Q9NVH1
  ENST ID: ENST00000377577
  CDS Start-End: 125-1804
gacggctccgggccgccaggggccgctgtggcgcagccgggctggcccgcgctgtccctgacgcggatcactggcccctcttgagcacggccttgccggtttggcggggtgaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggtgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcttgctgaaatattactgcttgaatctggagcagattgcgggtttataaaactgctttttatctgagaacaaacgggtttggaaattagtcgtcttttttccccactcccagagctgctcaagtcattccaccggccccctcggcttgggacagggtagtgtaactcccgatcccagggcctagccctgacacaggtggcttcccgtatcccggtgggaaaacgccctgccaccagcgggcttgagctggcctgtgtccctccaccgcctgcaccacccacctccagagtgcagtgctgggcaagggcagctcaagaggacaggaccaggcgcttggcaagacatcagacacacccaacccaaaggcgtggaccccaggcccggcccgtggtacccagcaggtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcactggtatctgagtaacggctaagaacctccttcctctggttttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgcaggtgcttctgggcacccatcctctgcgtttcatttgcagtcgactgtacagaaggcactcaccacaataaacctttcctgaaagcaga

SEQ ID NO: 127708 - DNA, 975 bp, Homo sapiens
  Payload ID: 4995
  Gene Symbol: DNAJC11
  Gene Name: DnaJ (Hsp40) homolog, subfamily C, member 11
  ENST ID: ENST00000426784
  CDS Start-End: 3-975
agatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagagaatgacagactgcctcatcatcgggttgattgacatatgccagagatgtagtccccagccagcctctgcttcctgtcgtctctgctgctgccatgtcacactcctagaactgtatatccctgtcccttctagaacgacagcagtgtcttcatttcctatatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactg

SEQ ID NO: 127709 - DNA, 1357 bp, Homo sapiens
  Payload ID: 4995
  Gene Symbol: DNAJC11
  Gene Name: DnaJ (Hsp40) homolog, subfamily C, member 11
  ENST ID: ENST00000451196
  CDS Start-End: 1-999
gcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcactggtatctgagtaacggctaagaacctccttcctctggttttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgcaggtgcttctgggcacccatcctctgcgtttcatttgcagtcgactgtacagaaggcactcaccacaataaacctttcctgaaagcaga

SEQ ID NO: 127710 - DNA, 1201 bp, Homo sapiens
  Payload ID: 4996
  Gene Symbol: DNAJC12
  Gene Name: DnaJ (Hsp40) homolog, subfamily C, member 12
  Uniprot ID: Q9UKB3
  ENST ID: ENST00000225171
  CDS Start-End: 154-750
catctggtgtattgactgtggccagtcttaaagctagtttttgctatgtggaacatgctgctctaattcagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctgtggagacttttcagaaactgcagaaggcaaaggagattctgaccaatgaagagagtcgagcccgctatgaccactggcgaaggagccagatgtcgatgccattccagcagtgggaagctttgaatgactcagtgaagacgtcaatgcactgggttgtcagaggtaaaaaagacctgatgctggaagaatctgacaagactcataccaccaagatggaaaatgaggaatgtaatgagcaaagagaaagaaagaaagaggagctggcttcaaccgcagagaaaacggagcagaaagaacccaagcccctagagaagtcagtctccccgcaaaattcagattcttcaggttttgcagatgtgaatggttggcaccttcgtttccgctggtccaaggatgctccctcagaactcctgaggaagttcagaaactatgaaatatgaaatatctctgcttcaaaaaatgaggaagagcaagactgtcccctatgctgccaacatgcagtctttgtttatgtcttaaaaatgtcatgtttatgtcatgtctgtgaattgctgagtactaattgattcctccatccttgaatcagttctcataatgctttttaaataagaaaaattcagaagatgaatttcttccaatatttgaataaattaaagctcttagatacagagtagattgtattatatgctttttcctattaatactacttatagaaatccattaaaaagcaatctctgtacagtgtatttaaatatttcattgacatactgtgatctctattagtgatggatgtacaaaaaatgttttcttacccttgacttacaatgaaatgtgaaattacttgtctgaaccccgtggggagaaataaataattttcccaaagttcataaa

SEQ ID NO: 127711 - DNA, 1064 bp, Homo sapiens
  Payload ID: 4996
  Gene Symbol: DNAJC12
  Gene Name: DnaJ (Hsp40) homolog, subfamily C, member 12
  Uniprot ID: Q9UKB3
  ENST ID: ENST00000339758
  CDS Start-End: 86-409
cagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctgtggagacttttcagaaactgcagaaggcaaaggagattctgaccaatgaagagagtcgagcccgctatgaccactggcgaaggagccagatgtcgatgccattccagcagtgggaagctttgaatgactcagtgaagacggtgggtttctcgctgggtgcgacgtgaatttgtgaagctcaggatgcccatggattagactcatgtagtagcttaaagagtcattaggcgataggagggagaaaaccaagaagttagcagagtctggatataattcagtgtccgtaaatcccatgaagagaagctcatcagaataaaggcaatgaatttgtgccagaagagcctgtgactacatttctttcaatctctttggctgtttgtttcagtatacacactccctgttattgcttactattttatgagctctaataaatgtacttctcaagttgctcatgaattgctgagttttaaccattgtaaattcacattctccatctttttagtttatgtcagcttgctctcttttcaaggcttagaattttcattaaaaaggcaggatctgattagtcagagaaagccatgaattattcctattaaacattctggtgaaagaattgttagactttaaaaacattgtgttatctttcttcatgtcattaaaaggcataaatatcaaaatattcactataattactgtcatatatttattttgttcaacattgacctttatatattatagacaaaatgtaattttaaagatttaggcatgatttattacctagattctctccattggaacacttttctatgacatgggacttat

SEQ ID NO: 127712 - DNA, 644 bp, Homo sapiens
  Payload ID: 4996
  Gene Symbol: DNAJC12
  Gene Name: DnaJ (Hsp40) homolog, subfamily C, member 12
  ENST ID: ENST00000480963
  CDS Start-End: 53-226
gctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctggtagacccaggagttaaatcagaatgtctcgcaagacttccagcatcatttgctcctataagcttacaaaatgagatctctcttcccagaactgtggagacttttcagaaactgcagaaggcaaaggagattctgaccaatgaagagagtcgagcccgctatgaccactggcgaaggagccagatgtcgatgccattccagcagtgggaagctttgaatgactcagtgaagacgtcaatgcactgggttgtcagaggtaaaaaagacctgatgctggaagaatctgacaagactcataccaccaagatggaaaatgaggaatgtaatgagcaaagagaaagaaagaaagaggagctggcttcaaccgcagagaaaacggagcagaaagaacccaagcccctagagaagtcagtctccccgcaaaattcagattct

SEQ ID NO: 127713 - DNA, 769 bp, Homo sapiens
  Payload ID: 4996
  Gene Symbol: DNAJC12
  Gene Name: DnaJ (Hsp40) homolog, subfamily C, member 12
  ENST ID: ENST00000483798
  CDS Start-End: 49-735
actgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctgacccaggagttaaatcagaatgtctcgcaagacttccagcatcatttgctcctataagcttacaaaatgagatctctcttcccagaactgtggagacttttcagaaactgcagaaggcaaaggagattctgaccaatgaagagagtcgagcccgctatgaccactggcgaaggagccagatgtcgatgccattccagcagtgggaagctttgaatgactcagtgaagacgtcaatgcactgggttgtcagaggtaaaaaagacctgatgctggaagaatctgacaagactcataccaccaagatggaaaatgaggaatgtaatgagcaaagagaaagaaagaaagaggagctggcttcaaccgcagagaaaacggagcagaaagaacccaagcccctagagaagtcagtctccccgcaaaattcagattcttcaggttttgcagatgtgaatggttggcaccttcgtttccgctggtccaaggatgctccctcagaactcctgaggaagttcagaaactatgaaatatgaaatatctctgcttcaaaaaatgaggaagagcaag

SEQ ID NO: 127714 - DNA, 590 bp, Homo sapiens
  Payload ID: 4996
  Gene Symbol: DNAJC12
  Gene Name: DnaJ (Hsp40) homolog, subfamily C, member 12
  ENST ID: ENST00000480180
  CDS Start-End: 156-278
gacatctggtgtattgactgtggccagtcttaaagctagtttttgctatgtggaacatgctgctctaattcagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcgatggagtttcactcttgttgtctaggctggagtgcaatggcgtgatctcggctcactgcaacctctgcctcctgggttcaagcattctccagcctcagcctcctgagtagctgagattacaggcgcccatgaccacacctgggttgaacaaatcctggcagaatttaaagtcagagctctggaatgtcacccagacaagcatcctgaaaaccccaaagctgtggagacttttcagaaactgcagaaggcaaaggagattctgaccaatgaagagagtcgagcccgctatgaccactggcgaaggagccagatgtcgatgccattccagcagtgggaagctttgaatgactcagtgaa

SEQ ID NO: 127715 - DNA, 7730 bp, Homo sapiens
  Payload ID: 4997
  Gene Symbol: DNAJC13
  Gene Name: DnaJ (Hsp40) homolog, subfamily C, member 13
  Uniprot ID: O75165
  ENST ID: ENST00000260818
  CDS Start-End: 249-6980
gcgaagatggcggcctccagagtgaaactctgagaggcagagggaggaggcggagggggcggggaggcagcgccgcggcggcaccaggaacccgcggcagcggagctgcagggccccggcgggggaaaggggaagtggtgagggtgaggaggccggagggcgcctcatcccactctggaagctgagccggcggcgggaggagctagggctggagcctctccagcctcccgcgaaggtttgagcacaaaatgaacataattagggaaaataaggatctggcatgtttctacacaacaaaacattcatggagggggaagtataagcgtgtcttttcagttggaactcatgcgattactacatataatcccaataccttagaagtaacaaatcagtggccttatggagacatttgcagcatcagccctgttggaaaaggacaaggaacggagttcaacctcacatttcgtaaaggcagtggaaaaaagtcagaaactttaaaattttctacagagcacagaacagaacttcttacagaagcattgagatttagaactgatttttcagagggaaaaatcacaggaaggagatacaactgctataagcatcactggagtgactcaagaaaacctgtaattttggaagtaactccaggaggctttgaccaaattaatcctgcaaccaacagagtactctgttcctatgactatagaaatattgaaggatttgtagatctctcagattatcaaggaggattttgtatactttatggaggatttagtagattgcatttatttgcgtcagagcaaagagaagagattattaaaagtgcaatagaccatgctggtaactacataggtatttcattgcggatcaggaaagagcctttagaattcgagcaatatttgaatcttcgctttggaaaatacagcactgatgaatccatcacatctttagcagagtttgtagtccaaaaaatatcacctagacattcggagcctgttaaaagagttctagcacttacagaaacatgtttagtagaacgtgatccggcaacctataatattgcaacattgaagcctttaggagaagtatttgcgttggtctgtgactcagaaaatccacaactttttaccattgaatttataaaagggcaagtacggaaatattcttcaacagagagagattccttattagcaagtttgctggatggagtaagagcctctggtaatagagatgtttgtgtaaaaatgacaccaacccataaaggtcagcgatgggggttactcagcatgcctgttgatgaggaagtagagagccttcacctcaggttcttagctacgcctccaaatggcaactttgcagatgctgtattcaggttcaatgctaatatttcatacagtggagtcctacatgcagtaacacaagatggtctcttctcagaaaacaaagaaaaactgatcaataatgccataacagcattactgtcccaagaaggggatgtcgttgcttcaaatgcggaacttgagagtcagttccaggctgtgaggaggcttgtggcatccaaagctggtttcctggctttcactcagcttccaaagtttcgcgagcgtctaggggtgaaggtagtaaaagcactcaaaagaagcaacaacggaataatccatgcagcagttgatatgctttgtgcccttatgtgtcccatgcatgatgactatgacttaagacaagaacagttgaacaaagcttctcttctctcgtcaaagaagtttctggaaaacttactggagaaatttaattcccatgtggatcatgggactggtgccctagttattagttcgctcttggacttccttacctttgccctctgtgctccatatagtgagacaactgaagggcagcagtttgatatgctcttggagatggtagcatccaatggaagaaccctttttaaactttttcagcatccttccatggcaataataaaaggagctgggttggttatgaaggcaataatagaggaaggtgataaagaaattgctacaaaaatgcaggagcttgccctaagtgaaggtgccttacctcgacacttgcatactgcgatgtttacaataagctcagatcaaaggatgcttacaaatagacagctaagtagacatttagtgggactctggacagctgataatgcaactgcaacaaacttgttgaaacgcattttgccgccaggcttgctggcatacttggaaagctcagatctcgtacctgagaaggatgctgatcggatgcatgttagagacaatgtgaaaatagcaatggatcagtatggaaaatttaataaagttccagagtggcaaagactagctggaaaagctgctaaagaagttgaaaaatttgccaaagaaaaagtggatcttgtattgatgcactggagggataggatgggcattgctcaaaaagagaatataaatcagaagccagtggttcttcgaaagagaagacaaagaataaaaatagaagcaaattgggatctcttctattataggtttggtcaagaccatgccaggtcaaaccttatttggaatttcaaaacacgagaagaactgaaagatactcttgaatctgaaatgagagcatttaatattgacagagaacttggaagtgcaaatgtgatctcctggaaccaccatgagtttgaggttaaatatgagtgcctggcagaggaaattaaaataggagactattacctgagattactattggaggaagatgagaatgaagaaagtggatcaattaagagatcgtatgaatttttcaatgagctttatcatcgcttcttgctcaccccaaaagtaaacatgaagtgtttatgtttacaagcccttgctattgtttatggcagatgtcacgaagaaataggaccttttacagataccagatatatcattggaatgttagagaggtgcacagataaacttgaacgagataggttgattctcttccttaacaagttgatccttaataagaaaaatgttaaggatctcatggattcaaatggaataagaatccttgtggacttgcttacccttgcacatctccatgtaagccgagctacagtaccactgcaaagcaatgtaattgaagctgctccagatatgaaaagagagagtgaaaaggaatggtattttggcaacgcagacaaagaaaggagtggcccgtatggatttcatgagatgcaagaattgtggaccaaaggaatgttaaatgcaaaaaccagatgctgggctcaaggcatggatggatggcgaccacttcagtccataccccagcttaagtggtgtctcttagccagtggacaggctgtcctgaatgaaactgaccttgctacccttatattgaacatgttgatcacaatgtgtggatattttccaagcagggatcaagacaatgccatcattcggcctctacccaaagtgaaaagactgctgtcagatagcacttgccttccccatattattcagctactgctgacctttgaccctatccttgttgagaaggttgctattttgttataccatatcatgcaagataacccacagttaccccgcctttatctgagtggagtatttttctttatcatgatgtacacaggttccaatgtgcttcctgttgctcgatttttgaaatacacacataccaaacaggctttcaagtcagaagagacaaaaggacaagatatttttcagagaagtatacttgggcacattctacctgaagcaatggtttgttacttagaaaattatgaacctgaaaagttttctgagatttttctaggagaatttgatactccagaagcaatctggagcagtgaaatgaggcgcctgatgatagagaagattgctgcccatctcgcggatttcacacctcgtcttcagagtaacacaagagcactttatcagtattgccccattcctataatcaactatccacaactcgaaaatgaactattttgtaatatttattacctcaaacaactgtgtgatacactccggtttccagattggccaattaaagacccggttaagcttctaaaagatacccttgatgcctggaagaaagaagtagaaaagaagccacctatgatgtcaatagatgatgcttatgaagtgcttaatctgcctcaaggacagggaccgcatgatgagagcaagattaggaaagcttacttcagacttgcacaaaagtaccaccctgataagaatccagaagggagggacatgtttgaaaaagtaaataaagcatatgaatttttatgtaccaaatcagcaaaaatagtggatgggccagatccagagaatataattttaattctaaaaacacagagcatcctcttcaaccgtcataaagaagatttacagccttataaatatgcaggataccccatgcttattcggactataacaatggaaacttcagatgacctccttttctcaaaagaatcaccattgttgcctgcggctacagagctagctttccatactgtcaactgttcagccctcaatgctgaagagctcagaagagagaatggactagaggtgttacaagaggcatttagtcgctgtgtggctgtcttgactcgtgctagtaaaccaagtgacatgtcagtacaggtgtgtggatacataagtaaatgctacagtgtggctgctcagtttgaggaatgccgagagaagatcacggaaatgcctagcatcatcaaggatctctgtcgggtactatattttggcaagagtattccccgcgtagctgctcttggggtagaatgtgtcagttcttttgctgtggatttctggctacagacacacctatttcaggctggaattttgtggtatctccttggttttctgtttaattatgactacacactagaagagagtggcattcagaaaagtgaagaaacaaaccagcaggaggtagcaaacagccttgccaaactgagtgtccatgctctgagtcgccttggagggtatttggctgaagaacaagcaactccagaaaatccaaccataaggaaaagcttagctggcatgctgacaccctatgttgctagaaaacttgctgtggctagtgtgactgagattttgaagatgcttaacagcaacacagaaagtccatatttgatatggaacaattctacaagagcagaattacttgaatttcttgaatcccaacaagaaaacatgattaaaaaaggtgattgtgacaaaacttatggatcagaatttgtctacagtgatcatgccaaagaacttattgtaggggagatttttgttagggtgtataatgaagttcctactttccaactggaggttccaaaagcatttgctgcaagtctcttggattatataggctcgcaggcccaatacttgcacacattcatggccatcacacacgcggcaaaagtggagtcagagcaacatggagatcgcttaccgagagtagaaatggctttggaggctctgagaaatgtcataaaatacaatccaggttctgagagtgaatgcattgggcactttaagttgatattttctcttctccgagttcatggagctggtcaagtgcagcagttggctttagaggttgtgaatatagtgacatctaaccaagactgtgtcaacaatattgctgaatcaatggttttgtccagtttattggctcttctacattcattgccatcaagtcgtcagcttgttctggaaactctttatgctttgacatcgagtacaaaaataatcaaagaagcaatggcaaagggtgctttgatctatttactggatatgttctgcaattcaacacatccacaggttcgagcccaaacagcagaactttttgccaaaatgacagcagataaactgataggtccaaaggttcgaattacgttaatgaaatttctaccaagcgttttcatggatgctatgagagacaatcctgaagctgctgtacatatttttgaaggaactcatgaaaatcctgagttaatttggaatgataattccagagataaagtgtccacaacagttagggaaatgatgctagagcactttaaaaatcagcaggacaaccctgaggcaaactggaagttgcctgaagattttgctgtggtgtttggagaagcagagggtgaacttgctgttggaggagtcttcttgaggatctttattgcacaaccagcctgggttctaagaaagcctagagaatttcttattgccctgttagaaaaattaactgagctcctagagaagaacaatcctcatggagaaactctggaaaccttgacaatggcaacagtgtgtctcttcagcgcacaacctcagctggcagatcaggtcccgccattgggccatcttcccaaagttatccaggcaatgaatcataggaacaatgccattcctaagagtgccattcgggttatccatgccttgtctgaaaatgagctgtgtgttcgagccatggcatctttagagaccattggcccactgatgaatggaatgaaaaagcgagcagatactgttggtctagcctgtgaagcaattaatcgaatgtttcagaaggagcagagtgaattagtagcacaagccctgaaagcagatttggttccatacctcttaaaattactcgaaggcattggccttgaaaacctggacagcccagcagccactaaggctcagattgttaaagctctcaaggcaatgactcgaagtttgcagtatggagaacaggtgaatgaaatcctgtgccgttcttcagtctggagtgccttcaaagatcagaaacatgatttgttcatttctgagtcacaaacagcaggatacctcacaggacctggagttgctggctaccttaccgcaggtacatctacatcagtcatgtctaacctgccacctcctgtagaccatgaggcaggcgaccttggctatcagacttgaaatattcacgagagacaataaacgctgaaaggccagtgccaagtccacattcctccagctgatacgttgaagcaaactcttactgcctttctcctggtttcatgacagtgttattcctttttctataaatatatttttaggaaaaaaagtcagtgatcctaattgtatcacattataagaaagcactctgtggatcaacataagtgggtacacaagaattttttttttcttggtgtatgtaagcacatttgttcctttatatctgtttacaaaactgtgaatcaaaaagacaaaactttcttcctagtttttgtaattttttttttgaactagcatgactgtagggttgagctacagtcaacaaaaattgggctaagtcacttttccccaggaaagaatatttccctctcctgcatcaagtctgcgtggccatcctccccccaccatccaagactattaggttttgtccctgcacccttcactggcatcctcaatcattaaccttctgaaagctcacagtacacattagtatgtataactggctttaccaaattgaatgaaaaggagcttgtgcaaaaaaatttaaaaatggatgtcaagatgttatgtaaaagatgagtgtaattgtgaaatgttctatacactatcaaatatataaagctttctatattgaatgtacattatacagatcattcatatgtgtacataaaattttaaaaataaagggaattgactgctttgttaatgaga

SEQ ID NO: 127716 - DNA, 801 bp, Homo sapiens
  Payload ID: 4997
  Gene Symbol: DNAJC13
  Gene Name: DnaJ (Hsp40) homolog, subfamily C, member 13
  ENST ID: ENST00000506813
  CDS Start-End: 1-522
tgcacagataaacttgaacgagataggttgattctcttccttaacaagttgatccttaataagaaaaatgttaaggatctcatggattcaaatggaataagaatccttgtggacttgcttacccttgcacatctccatgtaagccgagctacagtaccactgcaaagcaatgtaattgaagctgctccagatatgaaaagagagagtgaaaaggaatggtattttggcaacgcagacaaagaaaggagtggcccgtatggatttcatgagatgcaagaattgtggaccaaaggaatgttaaatgcaaaaaccagatgctgggctcaaggcatggatggatggcgaccacttcagtccataccccagcttaagtggtgtctcttagccagtggacaggctgtcctgaatgaaactgaccttgctacccttatattgaacatgttgatcacaatgtgtggatattttccaagcagggtactgtttttcaaggaaatcttatggaaggaaatgaagtcatattaagcagccaaatagatttaaaccaaaatacctaatcatgttcccagctgtatgagagcttagtcttcattaacaaaaaagtaagggatcaagacaatgccatcattcggcctctacccaaagtgaaaagactgctgtcagatagcacttgccttccccatattattcagctactgctgacctttgaccctatccttgttgagaaggttgctattttgttataccatatcatgcaagataacccacagttaccccgcctttatctgagtggagtatttttct

SEQ ID NO: 127717 - DNA, 673 bp, Homo sapiens
  Payload ID: 4997
  Gene Symbol: DNAJC13
  Gene Name: DnaJ (Hsp40) homolog, subfamily C, member 13
  ENST ID: ENST00000509279
  CDS Start-End: 1-290
atttggttccatacctcttaaaattactcgaaggcattggccttgaaaacctggacagcccagcagccactaaggctcagattgttaaagctctcaaggcaatgactcgaagtttgcagtatggagaacaggtgaatgaaatcctgtgccgttcttcagtctggagtgccttcaaagatcagaaacatgatttgttcatttctgagtcacaaacagcaggatacctcacaggtgtctctccttcccttctaactggcagcagcccccttcacctcaggagcgggctttagatccgctctgccaggcagcttgctaacttctgtgtagctctctgaagcaggacctggagttgctggctaccttaccgcaggtacatctacatcagtcatgtctaacctgccacctcctgtagaccatgaggcaggcgaccttggctatcagacttgaaatattcacgagagacaataaacgctgaaaggccagtgccaagtccacattcctccagctgatacgttgaagcaaactcttactgcctttctcctggtttcatgacagtgttattcctttttctataaatatatttttaggaaaaaaagtcagtgatcctaattgtatcacattataagaaagcactctgtggatcaacataagtgggtacacaagaatttttttt

SEQ ID NO: 127718 - DNA, 3330 bp, Homo sapiens
  Payload ID: 4998
  Gene Symbol: DNAJC14
  Gene Name: DnaJ (Hsp40) homolog, subfamily C, member 14
  Uniprot ID: Q6Y2X3
  ENST ID: ENST00000317269
  CDS Start-End: 205-2313
tggaagtaggcccaggtcgccggcggccgcggggacggaaggcggaagcagagcgtgagcgggaggcggagccgggagagcggctctcgtagctcaccctggccccaggccgggcggctcgagggggaggagttaccgccgttcttcggcatcagaacacaccatgatggctgtgacctaagaccctcaggaagccccggggtcatggcccagaagcaccccggagaaagagggttgtatggagcccaccacagtggtggtgcctccctcaggactttaggaccctccgtggaccctgaaataccttcattctcaggactcagggactcagcagggactgctcctaatggtacccgctgcctcacagagcactctggtcctaagcacacacagcacccaaacccagcccattggttggacccaagccatggccccccagggggtccaggaccacctagagatgcagaggaccctgatcagagtgagacgtcttcagaagaagaatcaggagtggaccaggaactctcaaaagaaaacgagactgggaaccagaaggatgggaactcttttctttccattccatctgcttgcaactgccagggaacacctggaattccagaagggccttactctgagggaggaaatggttcttctagcaacttttgccaccactgtacctctccagctttgggggaagatgagttggaagaggaatatgatgatgaagaatctctcaagttccccagtgatttttcacgtgtgtccagcggaaagaaacccccatcccggagacagcggcaccgctttccaacgaaggaggatactcgggagggtggacgtagggatcccaggtcccctggtcgacatcggctgggtcggaaacgaagtcaggcagataagcgcaaaggcctgggattgtggggagccgaggaactatgtcaacttggacaggcaggcttttggtggctgattgaactgctggtattggtgggagagtacgtagaaacttgtggccatctcatctatgcctgcaggcaactgaaaagcagtgatttggacctttttcgagtttggatgggagtgtggacagggcggttagggggctgggcccaggtcatgtttcagtttctaagccaggggttttactgtggagtaggactgtttactcgttttcttaagctgctgggtgctttgctgctcctggctctggccctctttttgggctttctacagttgggatggcggtttctggtgggactaggtgaccggttaggctggagggataaggctacctggctcttctcttggctggattctccagccttgcagcgttgcttgactctgctgagagatagcaggccatggcagcggctggtaagaatagttcagtggggctggctggagttgccttgggtcaagcagaatattaataggcaggggaatgcacctgtagctagtgggcgctactgccagcctgaagaggaagtggctcgactcttgaccatggctggggttcctgaggatgagctaaaccctttccatgtactgggggttgaggccacagcatcagatgttgaactgaagaaggcctatagacagctggcagtgatggttcatcctgacaaaaatcatcatccccgggctgaggaggccttcaaggttttgcgagcagcttgggacattgtcagcaatgctgaaaagcgaaaggagtatgagatgaaacgaatggcagagaatgagctgagccggtcagtaaatgagtttctgtccaagctgcaagatgacctcaaggaggcaatgaatactatgatgtgtagccgatgccaaggaaagcataggaggtttgaaatggaccgggaacctaagagtgccagatactgtgctgagtgtaataggctgcatcctgctgaggaaggagacttttgggcagagtcaagcatgttgggcctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgcccaatgggaacttctttgcagctcctcagcctgcccctggagccgctgcagcctctaagcccaacagcacagtacccaagggagaagccaaacctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcctgagtagctgggattacaggcacacaccaccacacctggcccagctaattcttttttgtatttttagtagagacggggtttcaccatgttgcccaggctggtctcgaactcctgagctcaggtgatccacccgtcttggcctcccaaagtgctggattacaggcataagccactgtgcccggcctgaatcttgtcttttgacaataccaaagaaatagggggtagctagagtaaagaacctagggcctggacctgggctggacagtgtatccctttaggtgtgggaactgggtatttccctggggtctgtatgcctttgtcttgtcatttgcttttagggcagatgacactttttcccacccttttaaagctacaagtctatcttctttcttgacccatttcaggagggagccctctcctttatcctgatataatatttaaaagagaacaagaaagcatgtagccctaatgataggagattatcgcatagagttcagagactggaaactgaattttccctcgactttcactttgtgggtaaatcacccaattttaggctcttttctgcaaggatggccaaaattaatcatttttaaaaagtagattcatgcccactgcccttgggtgagggggaagaatacgggggttcccagaagcccccatgtgatccaagggtttgtattttttttttaagtttgttcatatttgtatgtacatgactatttaaagccaggggattatctttctataaatgtataactggcaacctgtatcttccctctttgttgccc

SEQ ID NO: 127719 - DNA, 2774 bp, Homo sapiens
  Payload ID: 4998
  Gene Symbol: DNAJC14
  Gene Name: DnaJ (Hsp40) homolog, subfamily C, member 14
  Uniprot ID: Q6Y2X3
  ENST ID: ENST00000317287
  CDS Start-End: 440-2548
agagaattggagtattgtctcctggagaaccgggtggtcgggatcgtggaccagggaaggggcttttgctggtcggggagcgccaactgggggttcatgggtggaaaaactttcggatcaagacggggtataaggctagaggcgtgtgcagaggaggggaccgacggaacggggacccaactgggtctacgtgggggcgggggcgcttgtggacgtccaccaaatagcttggtatgcagatgagatgtcaagcagcaggtagatgagttcagtgttctttggctcacgggcaaagttctgagccgagccaagttacgctcccagttcctaggcaccgctcggtgatcgggcctggggagctgcgacccgaggggcggatccaggcatcagaacacaccatgatggctgtgacctaagaccctcaggaagccccggggtcatggcccagaagcaccccggagaaagagggttgtatggagcccaccacagtggtggtgcctccctcaggactttaggaccctccgtggaccctgaaataccttcattctcaggactcagggactcagcagggactgctcctaatggtacccgctgcctcacagagcactctggtcctaagcacacacagcacccaaacccagcccattggttggacccaagccatggccccccagggggtccaggaccacctagagatgcagaggaccctgatcagagtgagacgtcttcagaagaagaatcaggagtggaccaggaactctcaaaagaaaacgagactgggaaccagaaggatgggaactcttttctttccattccatctgcttgcaactgccagggaacacctggaattccagaagggccttactctgagggaggaaatggttcttctagcaacttttgccaccactgtacctctccagctttgggggaagatgagttggaagaggaatatgatgatgaagaatctctcaagttccccagtgatttttcacgtgtgtccagcggaaagaaacccccatcccggagacagcggcaccgctttccaacgaaggaggatactcgggagggtggacgtagggatcccaggtcccctggtcgacatcggctgggtcggaaacgaagtcaggcagataagcgcaaaggcctgggattgtggggagccgaggaactatgtcaacttggacaggcaggcttttggtggctgattgaactgctggtattggtgggagagtacgtagaaacttgtggccatctcatctatgcctgcaggcaactgaaaagcagtgatttggacctttttcgagtttggatgggagtgtggacagggcggttagggggctgggcccaggtcatgtttcagtttctaagccaggggttttactgtggagtaggactgtttactcgttttcttaagctgctgggtgctttgctgctcctggctctggccctctttttgggctttctacagttgggatggcggtttctggtgggactaggtgaccggttaggctggagggataaggctacctggctcttctcttggctggattctccagccttgcagcgttgcttgactctgctgagagatagcaggccatggcagcggctggtaagaatagttcagtggggctggctggagttgccttgggtcaagcagaatattaataggcaggggaatgcacctgtagctagtgggcgctactgccagcctgaagaggaagtggctcgactcttgaccatggctggggttcctgaggatgagctaaaccctttccatgtactgggggttgaggccacagcatcagatgttgaactgaagaaggcctatagacagctggcagtgatggttcatcctgacaaaaatcatcatccccgggctgaggaggccttcaaggttttgcgagcagcttgggacattgtcagcaatgctgaaaagcgaaaggagtatgagatgaaacgaatggcagagaatgagctgagccggtcagtaaatgagtttctgtccaagctgcaagatgacctcaaggaggcaatgaatactatgatgtgtagccgatgccaaggaaagcataggaggtttgaaatggaccgggaacctaagagtgccagatactgtgctgagtgtaataggctgcatcctgctgaggaaggagacttttgggcagagtcaagcatgttgggcctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgcccaatgggaacttctttgcagctcctcagcctgcccctggagccgctgcagcctctaagcccaacagcacagtacccaagggagaagccaaacctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcc

SEQ ID NO: 127720 - DNA, 3416 bp, Homo sapiens
  Payload ID: 4998
  Gene Symbol: DNAJC14
  Gene Name: DnaJ (Hsp40) homolog, subfamily C, member 14
  Uniprot ID: Q6Y2X3
  ENST ID: ENST00000357606
  CDS Start-End: 291-2399
ccctccaattctttcccgtgtgtgtggggggacccaggttgcctactgctctagtccaggaccagagacccccaactatatagcagtggaagtaggcccaggtcgccggcggccgcggggacggaaggcggaagcagagcgtgagcgggaggcggagccgggagagcggctctcgtagctcaccctggccccaggccgggcggctcgagggggaggagttaccgccgttcttcggcatcagaacacaccatgatggctgtgacctaagaccctcaggaagccccggggtcatggcccagaagcaccccggagaaagagggttgtatggagcccaccacagtggtggtgcctccctcaggactttaggaccctccgtggaccctgaaataccttcattctcaggactcagggactcagcagggactgctcctaatggtacccgctgcctcacagagcactctggtcctaagcacacacagcacccaaacccagcccattggttggacccaagccatggccccccagggggtccaggaccacctagagatgcagaggaccctgatcagagtgagacgtcttcagaagaagaatcaggagtggaccaggaactctcaaaagaaaacgagactgggaaccagaaggatgggaactcttttctttccattccatctgcttgcaactgccagggaacacctggaattccagaagggccttactctgagggaggaaatggttcttctagcaacttttgccaccactgtacctctccagctttgggggaagatgagttggaagaggaatatgatgatgaagaatctctcaagttccccagtgatttttcacgtgtgtccagcggaaagaaacccccatcccggagacagcggcaccgctttccaacgaaggaggatactcgggagggtggacgtagggatcccaggtcccctggtcgacatcggctgggtcggaaacgaagtcaggcagataagcgcaaaggcctgggattgtggggagccgaggaactatgtcaacttggacaggcaggcttttggtggctgattgaactgctggtattggtgggagagtacgtagaaacttgtggccatctcatctatgcctgcaggcaactgaaaagcagtgatttggacctttttcgagtttggatgggagtgtggacagggcggttagggggctgggcccaggtcatgtttcagtttctaagccaggggttttactgtggagtaggactgtttactcgttttcttaagctgctgggtgctttgctgctcctggctctggccctctttttgggctttctacagttgggatggcggtttctggtgggactaggtgaccggttaggctggagggataaggctacctggctcttctcttggctggattctccagccttgcagcgttgcttgactctgctgagagatagcaggccatggcagcggctggtaagaatagttcagtggggctggctggagttgccttgggtcaagcagaatattaataggcaggggaatgcacctgtagctagtgggcgctactgccagcctgaagaggaagtggctcgactcttgaccatggctggggttcctgaggatgagctaaaccctttccatgtactgggggttgaggccacagcatcagatgttgaactgaagaaggcctatagacagctggcagtgatggttcatcctgacaaaaatcatcatccccgggctgaggaggccttcaaggttttgcgagcagcttgggacattgtcagcaatgctgaaaagcgaaaggagtatgagatgaaacgaatggcagagaatgagctgagccggtcagtaaatgagtttctgtccaagctgcaagatgacctcaaggaggcaatgaatactatgatgtgtagccgatgccaaggaaagcataggaggtttgaaatggaccgggaacctaagagtgccagatactgtgctgagtgtaataggctgcatcctgctgaggaaggagacttttgggcagagtcaagcatgttgggcctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgcccaatgggaacttctttgcagctcctcagcctgcccctggagccgctgcagcctctaagcccaacagcacagtacccaagggagaagccaaacctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcctgagtagctgggattacaggcacacaccaccacacctggcccagctaattcttttttgtatttttagtagagacggggtttcaccatgttgcccaggctggtctcgaactcctgagctcaggtgatccacccgtcttggcctcccaaagtgctggattacaggcataagccactgtgcccggcctgaatcttgtcttttgacaataccaaagaaatagggggtagctagagtaaagaacctagggcctggacctgggctggacagtgtatccctttaggtgtgggaactgggtatttccctggggtctgtatgcctttgtcttgtcatttgcttttagggcagatgacactttttcccacccttttaaagctacaagtctatcttctttcttgacccatttcaggagggagccctctcctttatcctgatataatatttaaaagagaacaagaaagcatgtagccctaatgataggagattatcgcatagagttcagagactggaaactgaattttccctcgactttcactttgtgggtaaatcacccaattttaggctcttttctgcaaggatggccaaaattaatcatttttaaaaagtagattcatgcccactgcccttgggtgagggggaagaatacgggggttcccagaagcccccatgtgatccaagggtttgtattttttttttaagtttgttcatatttgtatgtacatgactatttaaagccaggggattatctttctataaatgtataactggcaacctgtatcttccctctttgttgccc

SEQ ID NO: 127721 - DNA, 756 bp, Homo sapiens
  Payload ID: 4998
  Gene Symbol: DNAJC14
  Gene Name: DnaJ (Hsp40) homolog, subfamily C, member 14
  ENST ID: ENST00000546957
  CDS Start-End: 520-756
gacggaaggcggaagcagagcgtgagcgggaggcggagccgggagagcggctctcgtagctcaccctggccccaggccgggcggctcgagggggaggagttaccgccgttcttcggtacgtccgtcttttttttttttttcgtttttttttgtttttttgagatggagtctcgctctgtcacccagactggagtacagtggcacgatctcggttcactgcaacctccacctcccgggttcaagcgattcttctgcctcagcctcccgagtagctgggactacaggtgcgcgccaccacgcctggcgaatttctgtatttttagtagagacggagtttcaccatgttggccaggctggtctcgaactcctgacctcgtgatccgccggcctcggcctcccaaagtgctgggattacaggcgtgagccacggtgcccggccaccttcgtcccttctacacagccggcatcagaacacaccatgatggctgtgacctaagaccctcaggaagccccggggtcatggcccagaagcaccccggagaaagagggttgtatggagcccaccacagtggtggtgcctccctcaggactttaggaccctccgtggaccctgaaataccttcattctcaggactcagggactcagcagggactgctcctaatggtacccgctgcctcacagagcactctggtcctaagcacacacagcacccaaacccagcccattggttggacccaagccatggccccccaggg

SEQ ID NO: 127722 - DNA, 638 bp, Homo sapiens
  Payload ID: 4998
  Gene Symbol: DNAJC14
  Gene Name: DnaJ (Hsp40) homolog, subfamily C, member 14
  ENST ID: ENST00000547445
  CDS Start-End: 186-638
gtgcgcgcggtggggggaggaggggtgacatcacaaggcaggcccctccaattctttcccgtgtgtgtggggggacccaggttgcctactgctctagtccaggaccagagacccccaactatatagcaggcatcagaacacaccatgatggctgtgacctaagaccctcaggaagccccggggtcatggcccagaagcaccccggagaaagagggttgtatggagcccaccacagtggtggtgcctccctcaggactttaggaccctccgtggaccctgaaataccttcattctcaggactcagggactcagcagggactgctcctaatggtacccgctgcctcacagagcactctggtcctaagcacacacagcacccaaacccagcccattggttggacccaagccatggccccccagggggtccaggaccacctagagatgcagaggaccctgatcagagtgagacgtcttcagaagaagaatcaggagtggaccaggaactctcaaaagaaaacgagactgggaaccagaaggatgggaactcttttctttccattccatctgcttgcaactgccagggaacacctggaattccagaagggccttactctgagggaggaaatggttcttctagc

SEQ ID NO: 127723 - DNA, 7853 bp, Homo sapiens
  Payload ID: 4999
  Gene Symbol: DNAJC15
  Gene Name: DnaJ (Hsp40) homolog, subfamily C, member 15
  Uniprot ID: Q9Y5T4
  ENST ID: ENST00000379221
  CDS Start-End: 425-877
ggtcaggaaagctcaggcaagcccaccctcaggcactacagctagactccgagcttactgggcagtcatctgattcgaccaacatcagttcgcagggcttaagcccagtcccttacggcggcctggggagggaccaggcccaagtatataaagctccctgagggtccgcgttggctttgcgcctgtgagtgtgattcaagaacgtcccagtgcccttggctcctttcggagtgtgaccccgtgcttgcacgggacacgttacccagctcgggtgagaagggtatcttccgggaacctcgcctttaatagcacaacgagcgcagagtccactggatctgcgagaagaaaccgcgctaactagtttgtccctacggccgcctcgtagtcactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagagactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatcttttaaagatctccttaaattctataactgatcttttttcttattttgtttgtgacattcatacatttttaagatttttgttatgttctgaattcccccctacacacacacacacacacacacacacacacacgtgcaaaaaatatgatcaagaatgcaattgggatttgtgagcaatgagtagacctcttattgtttatatttgtaccctcattgtcaatttttttttagggaatttgggactctgcctatataaggtgttttaaatgtcttgagaacaagcactggctgatacctcttggagatatgatctgaaatgtaatggaatttattaaatggtgtttagtaaagtaggggttaaggacttgttaaagaaccccactatctctgagaccctatagccaaagcatgaggacttggagagctactaaaatgattcaggtttacaaaatgagccctgtgaggaaaggttgagagaagtctgaggagtttgtatttaattatagtcttccagtactgtatattcattcattactcattctacaaatatttattgaccccttttgatgtgcaaggcactatcgtgcgtcccctgagagttgcaagtatgaagcagtcatggatcatgaaccaaaggaacttatatgtagaggaaggataaatcacaaatagtgaatactgttagatacagatgatatattttaaaagttcaaaggaagaaaagaatgtgttaaacactgcatgagaggaggaataagtggcatagagctaggctttagaaaagaaaaatattccgataccatatgattggtgaggtaagtgttattctgagatgagaattagcagaaatagatatatcaatcggagtgattagagtgcagggtttctggaaagcaaggtttggacagagtggtcatcaaaggccagccctgtgacttacactgcattaaattaatttcttagaacatagtccctgatcattatcactttactattccaaaggtgagagaacagattcagatagagtgccagcattgtttcccagtattcctttacaaatcttgggttcattccaggtaaactgaactactgcattgtttctatcttaaaatactttttagatatcctagatgcatctttcaacttctaacattctgtagtttaggagttctcaaccttggcattattgacatgttaggccaaataattttttttgtgggaggtctcttgtgcgttttagatgattagcaataatccctgacctgttatctactaaagactagtcgtttctcatcagttgtgacaacaaaaatggttccagatattgccaaatgccctttagaggacagtaatcgcccccagttgagaaccatttcagtaaaactttaattactattttttcttttggtttataaaataatgatcctgaattaaattgatggaaccttgaagtcgataaaatatatttcttgctttaaagtccccatacgtgtcctactaattttctcatgctttagtgttttcacttttctcctgttatccttgtacctaagaatgccatcccaatccccagatgtccacctgcccaaagtctaggcatagctgaaggccaagctaaaatgtatccctctttttctggtacatgcagcaaaagtaatatgaattatcagctttctgagagcaggcattgtatctgtcttgtttggtgttacattggcacccaataaatatttgttgagtgaatgaataaattcccatagcactttattcttcacatggtacataactataggggctatagcttggtaccttgtgaagcaactcttggtgtaacataccttatttctcatactaaaatgcaagaacctttagagcaaggatcttgccattcatctttgtaacctctttactctggagcacttgcatttagcaggcatcataaagttttacgtaccaagaaaatgttgctgttttctgaatactatgcatcaaaaaatgttaccactaatttttaaagctctgctaaggaatattggggcaccctcagatgcaccttttaattgatgtcatattttcctaatccatactttattcatgagaatttgagtcaccccagcattagcttggaatttccttatttcccatttgctttgcaggtgccttggagtcagatctggttttgaatactatcttcctgttatgtgatcttgggcagttacttaattttctagtcaataacccgtatctataaaatagagaaaataatcctacacaccggggcctgttgtggggcggggagaggggggagggatcgcatttggagatatactaatgtaaatgacaagttaattggtgcagcacaccaacatggctcatgtctacatatgtaacaaacctgcacgttgtgcacatgtgccctagaacttaaagtataataaaaagaaattttaaaaaatcctgtcaaataaggttatagtagagaataaggatgtgtaaagcatttagtcacgtaaatgcttaaaaaaatgtaatttttacttctttcactgcctcatttaattagttttatctttaataataccttggattcagggtaaagtttcagttatgtcccagtaatcatttattttaccctcgaatctgcaatttggatagaacatggtggggacagctcgtctctattccttgcagcattaacaggctggaggcaccacttctctggccagcaagttgggcctggttgttggctgagagcctcagttcctttctgcacaggttcctctttacataggcttctcaacagggctactagagcatcgtcaccatagcagctgtcttataacagagagtggtcggtctgagagacaaaaaatggaagctgccaaattgttctgggtctggaaactgtcagggcatcacttgtgccatattcagttggcctaagaattacagagcctgcctcgattcaaagggagaggatagagaggactgaaggaatcagtgctcatctttaatatgcagcaggacaggtttgggattttttttcccccttgagtctgtgaaggcattacttaagaacaaagtcaggcatgtataattgaactacagttacttgaaatataagcccagaaagtttcagataataaatacaactatttttctgctgttacccttgtacctaaagatgccatcctaatccccagatctccacaactatacctacatagtagaaggttaaaatgtatccctctttttctggtgcatccagcaaaagtaatatcatgaattatgagctctctgagagcaaggatcatatcagtcttgtttattgttgcagtgaacaagtacagttgcagatattcaggagtaattatctaaatggcagtaggcttataaaactgaattttcaccagccacaccctccccccaactccttatctgtaaaaagcttatttgagtggttacctgtcttcagtaaagattgcgcttgcatatttgctgtcattgcatattctgcttaattaagctctgttgatattgcagtttctgtgcatacttacatcttagatgcaatctgagggcctaggaaggccttttaaaaataaaacaattccgattgcagagaaagtgtaagtcaaggacagttaattcaaggggaacatagaaagctatttagattttagttgatggtgccagtcttcagcgtaaagtcaaaagtggagggaagtttagtaaggaaaaaatgttgggcttggaatacattgtttagtcttcaaagcactttactttttatgaaatatattttagacattcagcaaatattgaatacttactatatcaggcagtaaagatataaattcattcttaaaatgtgcaacatgttcaaactgaaaaaaatacattcttaaacaggaaactttttccttcatactttttaattaacaagacatataagagttgcattaatgggcgtgcttatgattgatcacccagcagcatcattagaaataatatattttattcatgtgcagaaatcttttggttgtcctggggaaccttgaacacagaaaagagcttttattgataaggtaattgaacacacttgacaattagcttaatatggtttaataccatttgtgggagaagatgaatcagccaggctctttacgtcaagaatatgaagtttctcttgagtcaaccaacttaagatgagctacggagactgcagtgaaaagttaaatatccaagtacaccagccaatttcacacagtggaaccatgctgtcctcgggcaccctgcacctcgcccaacagtcatcaactagatggaggctcctggctgcaaggaggatttgatgggaatgagtaaatgtgtcagcatagtccgtcccttctaatggaaaagcaacccaaagagcaaatcctattaatggctggatcagtatcatctacttgtcaaaaacattccatgaattatgagtcaaaattttatttatggtggcattacacacattaagagatgaggacttctgttagcataatttattagctggaaaagttgagaaggttctctggactcatttttataggtggaacctaagtgatctggataattgcccaccagcaaaattgctgggcatggtggacaaagaaaatgttccttctaatgattttttatgagctgagtagctattgttcccagctgagtgctcttttcctctttttattgttgctgagcaaaagaatttataaaaagctctttcttttgtattaaaaaccctgctcaattgaaatgcaagttcattaagtaatcttcatttctcttcctgccataataaccctttccctctctgttcgattcaacagtatctagcagcactgctccaaattttaagtctgaacagactatattacatagatgtagagaaatactcaatcttcagcattaagagggagcttaatttcacacgggtggaatatgatcactcaggctagatgttggccataaatttcaaattagtatctcaacttagcaggggggatcaacagtggcaaacttcaattatgacaggataaaaatcacatagagatattggttcaatatggacatctaaactataatgctaaaagccaataattagaataagttcattttaagaaaagcattaataatattagctaacgtttagtacctgtgccaaacattctacctatgttaccttgattttcatagccagcctaagaggtactattatgtatccccattttacaggttaagaaacaggctcagaggagtttaggatcttttccaagattacatagccagtaagtggtggcactaggaaccaaattcagactctgaatcgcatgctgtttatattatattgcactcattctaaatatgtgggaatcagaatgaaggggcttgtatgacttttggctcattttttgatgcatgtgacctgggattataaatgtgaaattaggtttacgaaaggatccagtgtcattgtgcatcatgggcaaggagtacctaatctctttaattcttccctggaagcttacgatgtccatccaagtgcacatagcaaaagttctgttgtaaagtttagcagagtgactttctttgactcagagtgatgacggaggaagctttgataagattttatctgaaatgttcatggacaagagctttcaaggagaacatccagagcaaggttctgaagacagctcatgaaggtgaagcagcagacctggcacaagaaatgaagagagagctcagtgtattaaagatgaaaacaagaaaaccgaatatattgaaaggagcagagaggcaatgaaaacaagacaactgaaatgaggtaacttgcagcaattgaaagggaatttcagtacttttatagaattcttaaaaattgtttcctgctgtttattttcaattttgaacagggttatttgtccatgccatactttttttgccaaattccaaaattgtgtatagttctatagttgtctggtggagtcaatggaactttagttaccagtctaagaatgtgtctttgagattgtccagttaattctctatttccagtagctgtaataaatggtgaaaaggtttctgactcctggagaaagtttctaactccttatgactaatattcataacagacttgtgagttccttgaacatggatacacctatatgcaagagtgtattccaaagctaactcagtgatctttccatttatctattcttggattagtggtgcctttgctctttccttctgtaaatgtgaatagttaagagttgactgcagaagtgtttacactttggcttccatgcctctggaatgtttgtgctttggtggtgagatgtgagactatatttgtatagtctgcatctctcaggctgccccagaatgttgtacagtgcagtgctgaagaaagcagcaggtacacacagaaatgcagcctttcctggttaaccctgcttggatctgagttacactttgtttcctgacttcttgggacttaggtaatcagtttgccttctactctatctcattttgtactcgcttacatactacattcttgtttgggctttcgtttcttcttgtaagcagagattttttaaaatccaatatgtgaaaatacggatgcactacaattaaataaataaaatgctgttgtgtttgttttgctttaaaattgtaaaggataaacaataagatagttttatctatgtggttttcccgatgcagttaaaataaaacctaatctgctaaaattgaatttacactcaa

SEQ ID NO: 127724 - DNA, 2357 bp, Homo sapiens
  Payload ID: 5000
  Gene Symbol: DNAJC16
  Gene Name: DnaJ (Hsp40) homolog, subfamily C, member 16
  ENST ID: ENST00000375838
  CDS Start-End: 165-1952
aagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcaggtttctctaacaaaacaccagactcacctccccggcacctgccccccagatcctgtcatctgataacgcagcattggaacatagagtgtagagaagaactctcatgcacctcctcccatgtaaactgtggctacagggaaaagtcactgtgatttgtgtttactaagaccctgtaggtgtttagatgccttagatttcataatgaaggcagaaggaaagaagcctatcaggcaagtgttaggtgagccagaagcaggacgtggtttatccctgtaaatgtcaatgaacgtaaccagtcttgtgcgcacacacacccagcagcaagaggccagggtctccgagacaaagaacatagactgaatgatagttgtcttcttcattctgtcctagagcaacttctgcacctgaaaagcag

SEQ ID NO: 127725 - DNA, 6069 bp, Homo sapiens
  Payload ID: 5000
  Gene Symbol: DNAJC16
  Gene Name: DnaJ (Hsp40) homolog, subfamily C, member 16
  Uniprot ID: Q9Y2G8
  ENST ID: ENST00000375847
  CDS Start-End: 165-2513
aagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccttgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttctttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaatttgttgctcaggtgttgcacaatttttatctaacactgaggctatcagctccaactaaacaacatttcagtgggtgaggctgccctaacttccattaggggccatggtctcactgccatcacttattagccatgagaatttggttgtagttttcaggtaggttggtttcttcctcatttgcagcttgttgatacttgttcctttttatttattaacatcccaatcaatttgcagctgccatcattacataaatatttttctgttataaaaagaagtgtgatctgtttttttagtgatttcctttgtttgggaatagagattggaagcacatactcagacctgttttgttaactagaattctttaaaagctgatgccaaacatctttacagaggaactgtagttcacatccacctgtctgacattgtcccctaaaaacaagtgcagtgtggcagctgctgaatctgtctgttcagtttgtcaaggaggataattatgcttgggagagatctgaaaagaaggtgaatattttgcacttttgatactcttaggaacaaataacttatttggcaaattgtttcttttttatgttttgggtgttgtttttgttttttgactttttttgtattgtgaacaggcactgaagctgatgttattttaagattacagaatggaaaaagaaataaactattttaatgtctgataa

SEQ ID NO: 127726 - DNA, 3446 bp, Homo sapiens
  Payload ID: 5000
  Gene Symbol: DNAJC16
  Gene Name: DnaJ (Hsp40) homolog, subfamily C, member 16
  ENST ID: ENST00000375849
  CDS Start-End: 165-2132
aagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactggaaagatcatacggtggtgaaacttcgacaagatcacagcccatcacgttcaggccttgacaacccctgatgatctccagagcctattcaagatcaagactgagttgtccacagtggtaatcatttacagtgaaaagcacccagtagagcttttcccagcccacgccaccctttgacttggaattggctttccctccataaacatttgttgactgccaggcacactggcaggcctcccagagaaacagataatgcgtacacagtccctgctcctcagggctgcatggtgtggtgatggagacaaggaaaccaatcgtttcaatgtcatgcaccaagggcttcaaggaaagcaagcccagaatggtatcagcataggtaatagcctggagaggtgggtaaggcttccccaaggtggaaatacccagttcaagggataggccaggcagagggaaaaacacaggcaaaggcaccaagatgggaaaagttcaggtagtaagatgtggccagaagacagagtaagtgagggagactgatgggaagagagtgaccttgtctgaaagggttcccatcctgcaggtgaaaagcccagaaggttgctaagcagagggatgaggaatgtgtttcagaaatccctcatgagaagagaggatggttacagccatttcaagagagagagttatggccaccctcctttaagatcttagaggatgtaaggtacttgattaggtttaagcagtcttcattcatttactctcaaatgtctttgagtgcctactatttgtattaggcactgtcctaggctccaaggacaaggtagggaacaatacataggtcctgcccttggggagattctagtcataaccattctgcccccgtgcatttactcccagcacacattattggagctttatttgggtgtttctaaaactcttgagcttaccttggcaggtaattgtgccatcacatgcacttttatttatttatttatttatttatttatttatttatttatttttgagacagggtctctgtcacccgggctatagtgcagtggtatgatcacggctcactgaaggcttgacctgccaggctcagttgatcctcctgccccagcctccctagtagctgggactacaggtgcacactagcacaccagactaatttttatttttatttttagtaaagatgggatctcactatgttgcccaggctgggctgaaactcctgggctcaaacgatccatccaccctggcctcccaaagtgctgaggatagtgcctgagccaccgcgcctggcccgttgtatgcacttttatttaaatttaaccctaaaaa

SEQ ID NO: 127727 - DNA, 6299 bp, Homo sapiens
  Payload ID: 5000
  Gene Symbol: DNAJC16
  Gene Name: DnaJ (Hsp40) homolog, subfamily C, member 16
  ENST ID: ENST00000475133
  CDS Start-End: 165-1952
aagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcaggtttctctaacaaaacaccagactcacctccccggcacctgccccccagatcctgtcatctgataacgcagcattggaacatagagtgtagagaagaactctcatgcacctcctcccatgtaaactgtggctacagggaaaagtcactgtgatttgtgtttactaagaccctgtaggtgtttagatgccttagatttcataatgaaggcagaaggaaagaagcctatcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccttgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttctttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaatttgttgctcaggtgttgcacaatttttatctaacactgaggctatcagctccaactaaacaacatttcagtgggtgaggctgccctaacttccattaggggccatggtctcactgccatcacttattagccatgagaatttggttgtagttttcaggtaggttggtttcttcctcatttgcagcttgttgatacttgttcctttttatttattaacatcccaatcaatttgcagctgccatcattacataaatatttttctgttataaaaagaagtgtgatctgtttttttagtgatttcctttgtttgggaatagagattggaagcacatactcagacctgttttgttaactagaattctttaaaagctgatgccaaacatctttacagaggaactgtagttcacatccacctgtctgacattgtcccctaaaaacaagtgcagtgtggcagctgctgaatctgtctgttcagtttgtcaaggaggataattatgcttgggagagatctgaaaagaaggtgaatattttgcacttttgatactcttaggaacaaataacttatttggcaaattgtttcttttttatgttttgggtgttgtttttgttttttgactttttttgtattgtgaacaggcactgaagctgatgttattttaagattacagaatggaaaaagaaataaactattttaatgtctgataa

SEQ ID NO: 127728 - DNA, 445 bp, Homo sapiens
  Payload ID: 5000
  Gene Symbol: DNAJC16
  Gene Name: DnaJ (Hsp40) homolog, subfamily C, member 16
  ENST ID: ENST00000472665
  CDS Start-End: 1-293
ctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcaggtttctctaacaaaacaccagactcacctccccggcacctgccccccagatcctgtcatctgataacgcagcattggaacatagagtgtagagaagaactctcatgcacctcctcccatcaagattcctaaaaaaggctttgtggaggtaactgaactcaca

SEQ ID NO: 127729 - DNA, 5882 bp, Homo sapiens
  Payload ID: 5000
  Gene Symbol: DNAJC16
  Gene Name: DnaJ (Hsp40) homolog, subfamily C, member 16
  Uniprot ID: Q9Y2G8
  ENST ID: ENST00000616884
  CDS Start-End: 916-2328
aagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccttgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttctttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaatttgttgctcaggtgttgcacaatttttatctaacactgaggctatcagctccaactaaacaacatttcagtgggtgaggctgccctaacttccattaggggccatggtctcactgccatcacttattagccatgagaatttggttgtagttttcaggtaggttggtttcttcctcatttgcagcttgttgatacttgttcctttttatttattaacatcccaatcaatttgcagctgccatcattacataaatatttttctgttataaaaagaagtgtgatctgtttttttagtgatttcctttgtttgggaatagagattggaagcacatactcagacctgttttgttaactagaattctttaaaagctgatgccaaacatctttacagaggaactgtagttcacatccacctgtctgacattgtcccctaaaaacaagtgcagtgtggcagctgctgaatctgtctgttcagtttgtcaaggaggataattatgcttgggagagatctgaaaagaaggtgaatattttgcacttttgatactcttaggaacaaataacttatttggcaaattgtttcttttttatgttttgggtgttgtttttgttttttgactttttttgtattgtgaacaggcactgaagctgatgttattttaagattacagaatggaaaaagaaataaactattttaatgtctgat

SEQ ID NO: 127730 - DNA, 3731 bp, Homo sapiens
  Payload ID: 5001
  Gene Symbol: DNAJC17
  Gene Name: DnaJ (Hsp40) homolog, subfamily C, member 17
  Uniprot ID: Q9NVM6
  ENST ID: ENST00000220496
  CDS Start-End: 32-946
agttgtagtacgaatccgtcaggccggaaccatggcagtgaccaaggagctcttacagatggacctgtacgcgctgctaggcattgaggagaaggcagcggacaaagaggtaaagaaggcgtataggcagaaggccctctcctgccacccagacaaaaatccagataatcccagagcagctgaactcttccaccagctttctcaggccttggaggtgctgaccgatgctgcagccagggctgcatatgacaaggtcaggaaagccaagaagcaagcagcagagaggacccagaaacttgatgagaaaaggaagaaagtgaagcttgacctggaggcccgggagcggcaggcccaggcccaggagagtgaggaggaagaggagagccggagcaccaggacactagagcaagagatcgaacgcctgagagaagagggttcccggcagctggaggaacagcagaggctcatccgggagcagatacgccaggagcgtgaccagaggttgagaggaaaggcagaaaatactgaaggccaaggaacccccaaactaaagctaaaatggaagtgcaagaaggaggatgagtcaaaaggtggctactccaaagacgtcctcctacggcttttgcagaagtatggtgaggttctcaacctggtgctttccagtaagaagccaggcactgctgtggtggagtttgcaaccgtcaaggcagcggagctggctgtccagaatgaagttggcctggtggataaccctctgaagatttcctggttggagggacagccccaggatgccgtgggccgcagccactcaggactgtcaaagggctcagtgctgtcagagagggactacgagagcctcgtcatgatgcgcatgcgccaggcggccgagcggcaacagctgatcgcacggatgcagcaggaagaccaggaggggccgcctacgtagccccagctccagccatccacccctcagcccttttcttcaacgtcaccaataaattttttttttttttaagattttacctctatcccatacataggtataaggtgctgggctctgccgcagagcgctccacccaggcctggcgcccctcccaggaagtgggcagacccccagggaaacgctccgcagggtgagagtcccagagtccgtgcacaagcagagcacaggcgcagccactcatcacagccctttattggcttgggctagctatgcaggagccacgcgccagggccgctggagtgcccagctccggcccggggcagctgcccgaggaacatggcctacacaaggccctcggcccaggcccgaagcaggagggcagctgggagcaccagggcaccgggcactgccctctcccactgcttgacgcagggtttcagagaaggccattcactgccctttggggctgggcccatggcggtgatgatttgggaagagaggagcaaggcagacggtgaggcaggagcttggaggtcagggcccacagcagcccctccacaggggtgccccgtctgcaaatcagcatgagaaggtcactccttgtgcagacaccacaccagcgtctggcccacccccgtcatgctcagcacacggaagcccctgcgttccagcttgtccaggactatgcggggagggtcatcgacgtagtattcataactgcaaagagacaggatggggggggtgaggaggggcacacagcaagctcctggtacaaagctagtgtctgcagcaggcagcctggccactcttgtagtgactcacacttgctggctgcttgctgggcgctggggtaagtgcacgccccctgcctcctccccttctaggtacttcacgagctatctcatttattcttcccaacaagctagtgaaggtgccactgttgtggccattgatagatgagaaaacagaggggttaatcaggttccccagcgtcccagatggtagaccatgttagtctgaccacagccctgctgccgccctccctgggcttgctccccacccaggcttccaggtaggaggaggctgaggctgcagtgagccatgattgcaccaccgcactccagcctgggcgacagagactccatttcaaaaaaaaataagcctccaggcccctcactgccctggctgtcctgcagttctgtagcaacaaggctgagccccagtagctcctggctctgtgcgccactccctagcatggagagtgctggtagtccttctgtcaggtttaattgatgctgaaagaccatgaagcagacaaagggctcaagccccaagctgggcatggagaggcaagtgcctcatggcaaagggagggggctggcttctgtccccgagccttgacccaggggctgggatcagccctcctctttccccgatttgaactggcactcactctgacaactcttttcagagagcctgtgtagcttgggttctccctgcctccaggggtgagaggaggaatggaagcagtagtcacagtttagacatggaggcattaggaagaatgccaagggaaatggctaggtccccaggcagcagccaccctggaggtaggacgcaggctccctgctccctgcttctagggcttagctttgcgactcatgcagatcctcacgacaaaaacctttctctctgtgcctgtctgtccttgatggggtccagcttaggagagggcagggcaaggaacagtctgctagtggagtcctagacccagggaacggactctgtttctgcggttccagtaaggatgtggaaagctttcagagcaagcctcgtgggggagaggggggatgttggagaggctacagatgggaccaactcctccggagaacagagccccaggatgcaggcagggggctctgatgctgggccctgtccctgggcttggaggttgtataaagggagcagaggcaggtctaggggctggcagggagaggatactgagggaggctgctacttacaagttgtttcccaaggctcttctctttgaagcccccagatgctgcatcagctctggatccgactgttcatcgcccaccatagtggggcccacctcctgcaaggtaagccacagtggctgcttggctggctgccaggaggaggtggaaggtcttgcctgtccttcctcccctgcctgctagccctgagtaaggttcaggtaaaggctacagagagtagcaaggattcttaggggctgagcacaagctgtgaaggggtggagcccatcaatgatcaggaggagcaatgtaggcgccctccctagtgccttaaagctcagctttagccaggcaaagtatcacgagcctatagttccagctactgaggctgaggtgggaggatcgcttgaggtgggaggagtttgaggctgcagtgagccatgattgcaccactgcactccagcctgggtgacagagtgagactccatttcaaaaaaacaaaacaaaataaacatgtaaatgaaagaagccagactcagatcacattaccacagaaaggtaattagtggttatctagggctgagggacttgggggaaatcaagagtgtctgccagtgggtacagggtttccttttggggtattagaaatgttctaaaactgattatggtgatggttgcacaactctgagtacactaaagaaacaacaacactgaattgtacactttaaatcaaagaatttatggtatgcacattacatatcaataaagccatatcttttaagaaataagaa

SEQ ID NO: 127731 - DNA, 903 bp, Homo sapiens
  Payload ID: 5001
  Gene Symbol: DNAJC17
  Gene Name: DnaJ (Hsp40) homolog, subfamily C, member 17
  ENST ID: ENST00000560645
  CDS Start-End: 28-459
gtagtacgaatccgtcaggccggaaccatggcagtgaccaaggagctcttacagatggacctgtacgcgctgctaggcattgaggagaaggcagcggacaaagaggtaaagaaggcgtataggcagaaggccctctcctgccacccagacaaaaatccagataatcccagagcagctgaactcttccaccagctttctcaggccttggaggtgctgaccgatgctgcagccagggctgcatatgacaaggtcaggaaagccaagaagcaagcagcagagaggacccagaaacttgatgagaaaaggaagaaagtgaagcttggtaggtgccatcatagtgctcggtggcctgtggtttcctgtggtcattttcattcatctccctcacctgaagcttcacttccagcaactcatctcaaagccttttggctcaggctctgggcaaaacgctgttcttagagacctggaggcccgggagcggcaggcccaggcccaggagagtgaggaggaagaggagagccggagcaccaggacactagagcaagagatcgaacgcctgagagaagagggttcccggcagctggaggaacagcagaggctcatccgggagcagatacgccaggagcgtgaccagaggttgagaggaaaggcagaaaatactgaaggccaaggaacccccaaactaaagctaaaatggaagtgcaagaaggaggatgagtcaaaaggtggctactccaaagacgtcctcctacggcttttgcagaagtatggtgaggttctcaacctggtgctttccagtaagaagccaggcactgctgtggtggagtttgcaaccgtcaaggcagcggagctggctgtccagaatgaagttggcctggtggataaccctctgaagatttcctg

SEQ ID NO: 127732 - DNA, 880 bp, Homo sapiens
  Payload ID: 5001
  Gene Symbol: DNAJC17
  Gene Name: DnaJ (Hsp40) homolog, subfamily C, member 17
  ENST ID: ENST00000561018
  CDS Start-End: 28-423
gtagtacgaatccgtcaggccggaaccatggcagtgaccaaggagctcttacagatggacctgtacgcgctgctaggcattgaggagaaggcagcggacaaagaggtaaagaaggcgtataggcagaaggccctctcctgccacccagacaaaaatccagataatcccagagcagctgaactcttccaccagctttctcaggccttggaggtgctgaccgatgctgcagccagggctgcatatgacaaggtcaggaaagccaagaagcaagcagcagagaggacccagaaacttgatgagaaaaggaagaaagtgaagcttgacctggaggcccgggagcggcaggcccaggcccaggagagtgaggaggaagaggagagccggagcaccaggacactagagcaagaggttgctgagccctagcttgcaggtggaagctcccaaggactttttacaaggtgagccagcctggaattggacctgcacagaattgtcacccccaccccctgctctgcagatcgaacgcctgagagaagagggttcccggcagctggaggaacagcagaggctcatccgggagcagatacgccaggagcgtgaccagaggttgagaggaaaggcagaaaatactgaaggccaaggaacccccaaactaaagctaaaatggaagtgcaagaaggaggatgagtcaaaaggtggctactccaaagacgtcctcctacggcttttgcagaaggtcggccctgttgacgtccactctttcctatcatctcagtccacgtctcagtccacaccctagtatggtgaggttctcaacctggtgctttccagtaagaagccaggcactgctgtggtggagtttgcaaccgtcaaggcagcg

SEQ ID NO: 127733 - DNA, 1341 bp, Homo sapiens
  Payload ID: 5001
  Gene Symbol: DNAJC17
  Gene Name: DnaJ (Hsp40) homolog, subfamily C, member 17
  ENST ID: ENST00000559238
  CDS Start-End: 28-336
gtagtacgaatccgtcaggccggaaccatggcagtgaccaaggagctcttacagatggacctgtacgcgctgctaggcattgaggagaaggcagcggacaaagagataggttgccccagtttatatgcccaccaagaatgtgtagagtacctgtcttcgagtggctgtcgagaaagcggggtactgtgctcctgcctgttgcagcagcccctggacatctgcagtggtgaggttgagcacttagcaggaggtgggcccagctcctgtgctgggcgacagtggctcactccctccatggccttggcctcctccattgccagtctccctggtggctaggaagtgggcgccagcagcttctcttttaggtaaagaaggcgtataggcagaaggccctctcctgccacccagacaaaaatccagataatcccagagcaggtgagactcttctcagggcgtggggagaaagaaacccactcacccgggcattgtgtttcccgatgtaagctctgcatctgaactcttccaccagctttctcaggccttggaggtgctgaccgatgctgcagccagggctgcatatgacaaggtcaggaaagccaagaagcaagcagcagagaggacccagaaacttgatgagaaaaggaagaaagtgaagcttgacctggaggcccgggagcggcaggcccaggcccaggagagtgaggaggaagaggagagccggagcaccaggacactagagcaagagatcgaacgcctgagagaagagggttcccggcagctggaggaacagcagaggctcatccgggagcagatacgccaggagcgtgaccagaggttgagaggaaaggcagaaaatactgaaggccaaggaacccccaaactaaagctaaaatggaagtgcaagaaggaggatgagtcaaaaggtggctactccaaagacgtcctcctacggcttttgcagaagtatggtgaggttctcaacctggtgctttccagtaagaagccaggcactgctgtggtggagtttgcaaccgtcaaggcagcggagctggctgtccagaatgaagttggcctggtggataaccctctgaagatttcctggttggagggacagccccaggatgccgtgggccgcagccactcaggactgtcaaagggctcagtgctgtcagagagggactacgagagcctcgtcatgatgcgcatgcgccaggcggccgagcggcaacagctgatcgcacggatgcagcaggaagaccaggaggggccgcctacgtagccccagctccagccatccacccctcagcccttttcttcaacgtcaccaataaattttttttt

SEQ ID NO: 127734 - DNA, 792 bp, Homo sapiens
  Payload ID: 5001
  Gene Symbol: DNAJC17
  Gene Name: DnaJ (Hsp40) homolog, subfamily C, member 17
  ENST ID: ENST00000559310
  CDS Start-End: 12-407
aggccggaaccatggcagtgaccaaggagctcttacagatggacctgtacgcgctgctaggcattgaggagaaggcagcggacaaagaggtaaagaaggcgtataggcagaaggccctctcctgccacccagacaaaaatccagataatcccagagcagctgaactcttccaccagctttctcaggccttggaggtgctgaccgatgctgcagccagggctgcatatgacaaggtcaggaaagccaagaagcaagcagcagagaggacccagaaacttgatgagaaaaggaagaaagtgaagcttgacctggaggcccgggagcggcaggcccaggcccaggagagtgaggaggaagaggagagccggagcaccaggacactagagcaagaggttgctgagccctagcttgcaggtggaagctcccaaggactttttacaaggtgagccagcctggaattggacctgcacagaattgtcacccccaccccctgctctgcagatcgaacgcctgagagaagagggttcccggcagctggaggaacagcagaggctcatccgggagcagatacgccaggagcgtgaccagaggttgagaggaaaggcagaaaatactgaaggccaaggaacccccaaactaaagctaaaatggaagtgcaagaaggaggatgagtcaaaaggtggctactccaaagacgtcctcctacggcttttgcagaagtatggtgaggttctcaacctggtgctttccagtaagaagccaggcactgctgtggtggagtttgcaaccgtc

SEQ ID NO: 127735 - DNA, 704 bp, Homo sapiens
  Payload ID: 5001
  Gene Symbol: DNAJC17
  Gene Name: DnaJ (Hsp40) homolog, subfamily C, member 17
  ENST ID: ENST00000560065
  CDS Start-End: 7-384
ggaaccatggcagtgaccaaggagctcttacagatggacctgtacgcgctgctaggcattgaggagaaggcagcggacaaagaggtaaagaaggcgtataggcagaaggccctctcctgccacccagacaaaaatccagataatcccagagcagctgaactcttccaccagctttctcaggccttggaggtgctgaccgatgctgcagccagggctgcatatgacaaggtcaggaaagccaagaagcaagcagcagagaggacccagaaacttgatgagaaaaggaagaaagtgaagcttgatcgaacgcctgagagaagagggttcccggcagctggaggaacagcagaggctcatccgggagcagatacgccaggagcgtgaccagaggttgagaggaaaggcagaaaatactgaaggccaaggaacccccaaactaaagctaaaatggaagtgcaagaaggaggatgagtcaaaaggtggctactccaaagacgtcctcctacggcttttgcagaagtatggtgaggttctcaacctggtgctttccagtaagaagccaggcactgctgtggtggagtttgcaaccgtcaaggcagcggtgagtgctgcatgaggcttgggggcccctcgtggccctgtcattctagggcagggacccaattctgtgggccctctgagttaggtggtctgcactcctaggg

SEQ ID NO: 127736 - DNA, 428 bp, Homo sapiens
  Payload ID: 5001
  Gene Symbol: DNAJC17
  Gene Name: DnaJ (Hsp40) homolog, subfamily C, member 17
  ENST ID: ENST00000627802
  CDS Start-End: 33-428
gagttgtagtacgaatccgtcaggccggaaccatggcagtgaccaaggagctcttacagatggacctgtacgcgctgctaggcattgaggagaaggcagcggacaaagaggtaaagaaggcgtataggcagaaggccctctcctgccacccagacaaaaatccagataatcccagagcagctgaactcttccaccagctttctcaggccttggaggtgctgaccgatgctgcagccagggctgcatatgacaaggtcaggaaagccaagaagcaagcagcagagaggacccagaaacttgatgagaaaaggaagaaagtgaagcttgacctggaggcccgggagcggcaggcccaggcccaggagagtgaggaggaagaggagagccggagcaccaggacactagagcaagaggttgctgagccctag

SEQ ID NO: 127737 - DNA, 5103 bp, Homo sapiens
  Payload ID: 5002
  Gene Symbol: DNAJC18
  Gene Name: DnaJ (Hsp40) homolog, subfamily C, member 18
  Uniprot ID: Q9H819
  ENST ID: ENST00000302060
  CDS Start-End: 82-1158
cgtgccccgcgctccgcgcccccttctctttcagcctcgggcacgggggaggctcggcggacctgctgattgggaaccgatatggcggcgactctgggcagcggggagcgctggacggaagcttacattgacgcagttagaagaaacaaatacccagaagacacacctcctgagagtcatgacccctgtggctgctgtaactgcatgaaggcacaaaaggaaaagaagtctgagaatgagtggactcagacccggcagggtgaggggaactccacgtatagtgaggaacagctgcttggggtacaaaggatcaagaaatgcagaaattactatgaaattctgggagtttctcgagatgctagtgacgaagagcttaagaaagcttacagaaaactcgccctgaaatttcaccctgacaagaactgtgctcctggagcaacagatgctttcaaagcaataggaaatgcatttgcagtcctgagcaatcctgataagagacttcgctatgatgaatacggagatgaacaggtgactttcactgcccctcgagccagaccttataattattacagggattttgaagctgacatcactccagaagagctgttcaacgtcttctttggaggacattttcctacaggaaatattcatatgttttcaaatgtgacagatgacacttactattaccgtcgacggcaccgacatgagaggacacagactcagaaggaggaggaagaagagaaacctcagactacatattctgcatttattcagctacttccagttcttgtgattgtgattatatctgtcattactcagctgctggctactaatcccccatatagtctgttctataaatcgaccttgggctacaccatttctagagaaactcagaacctgcaggtgccttactttgtggataaaaactttgacaaggcctacagaggagcttctctgcatgacttggagaaaacaatagagaaggattacattgattatatccagactagttgttggaaggagaaacaacaaaagtcagagctgacaaatttggcaggattatacagagatgaacgattgaaacagaaagcagagtcgctgaaacttgaaaactgtgagaaactttccaaactcattggcctacgcagaggtggctgagaggataatggtcctacgcagggctggggttttgctacttgttcctatttatgttcctgattccattttataatacaaaactaggtaatgatgaacactttactatttgctaacttcgttggttgggcagagtggcaggagcatgggcacgagagccagatgtgtcttcacaggatccttcctggggagtggctccagggaccaggagtagttcatctaagttaaattaatggcaaggcattggattccgtctccctgctccatgcctaccctgcctatgtgaatggagttcagggcatcccagagcagatccatgctttcttccttcttcccttcttcagtgaagtcttaagaaccaggcattcctaggcttagccaaagcttaatattagttatttacactgtctaccaagaattatacctctcccttcattagagtcatcatctccgccaagatttagcctttggaacatgttcctgcccagctttccattttctaggggaatatggagaaatttaaactattgtagtcaatagttttctattattccaatctctgctcagttagtagcattagcaaactgcctaatttgagattcctttatttccttaaccctctctcctttagagagtccagaaattaaaactactgagcagcatctggaggcgggggccagggcgaaggtataatgcaagaccgagcctcatctcctccacgaagcctccctactccatcatagaacccagagaatgtcccttcggtcatttcccctcagtatcatcattggtgtcatcgcacttaggctgagttcctacatcccacagaggcagatggtcagacccaggaggaggcattgccagctctccaggctgtttgctcaagcctagagatagaggagacagatcctctctccttggatatgggggtctagctttggccccagcagccactttgtttaacccagtatcctatagtttgtgatttgagatgatttttcattcattcaacatttattgagtgcctactataaaagcaggggctctcacacatattttcttacttaaacctcctcacaactctgaagtagatgtattatccctggttctatgaatgagaacattggcccagagaggatgacccaggtcttgtagtggcagagcaagacggtaggctgagtgtcaagtagaaagtgggagagcatcctcatgtctcaggtgattctagccagactggcaaagcagaacctttcccgaggatgcctccgtcctccccaaccccatgacccctcatcttttctgtggcaatcttgcatctgttcaggacaacatccctgctgctctttaggaagcaggaccctgtctaacataaattctgtacacaaaataagaggtccctcacaggcaggcagccctccactggtgactaggaagaattcagtcactgcctgggctgtgtggttctgggccttcctgtggagctgagctgcctgaattatcatgactctgaacttggaaggatcattaagtgactgtagcctacactccatgcttccttcatattggaagaaaagtttctggtagagagtcggccgggtgcactggctcaagcctgtaatcccagcactttgggaggctgtggcaggtggatcacctgaggtcaggagttcaagaccagcctggccaacacagtgaaaccccatctctactaataatacaaaaattagccaggtgtggtggcacatgcctgtagtcccagctactcgggaggctgaggcatgagaatcgctgcaacttgcaaggtggaggttacagtgagctgaaatcacgccactgcactccactccatctcaaaaaaaaaaagagtctacattaaacagattccaaagtaaagtttcttcatcccaatgcatggccatgatttacacagacgtgcctagcatggctcatcaacatctgaacggttgttccctaccatgcctctgcaggcattccacagagtcaggagatgggttcacaggtaaagattgggggctttagtggcttgtaggggacaactgctcagttgcagggagagggagcatttctagaaatagccagattttgctgcccaactagatctgtcctcctggttttagggggcccttcttgatcccctctgagtgactgagggaggttacattgtaaaatatgtccatgagccaaacaggcttatggaaagttcttctacacacaaaaaaatcaaagctctcctctccccatccccaaccactgctagaaaattggccataatgaaactgacttgacaggttaaaagaccctgtcctagatgcccaggaatcaggtagtcacacattttatggacttcatggcagcgataagtaatctgtgatgatactaaatagaagcaataataactaactccattaaatgtcacgctgattgtctgtttttatagcaccgatggtactgttttatttattgccaatagaccacaacattcacatctgtttttcctcaagggaaccgtatttgcttttggttgaaggatttatctatttgatactatccagaatattgtgaagctataatttcctgggttatattttagatgggttgtctgcatggtggtaaaataagctttttcctctcgcctacgtcctttggaagatctcctgatcatacataactaggtagggcttattcttgctgccggagcttggcacccagctctagactgtttctttgagcattactgcagattggagacgtgtgtgagaggagcagcgctcagaaatagggcttgaggctcaagcagaaactgaagctctcattcaaatgaagatgctctctctaccgcacgatcggcagtgagaaaaggaggatgaaaatccttctcatcacaaagagcttgaaggaacccacgtccccagattagcaaccctagagttcatctgctcaggccgggaaatgtgtaagcttccttgatcagctccaggcctcacagcacgggagcagtgaccagtaaggaaacgtcactgctgtgctttctgttggaaattgttcgaaaatacagtgaactggccaggcccagtagctcatgcctgtaatcccagcactttgaaaggctgaggcaggcagatcatttgaggtcaggagttccagaccagcctggccaacatggtgaaaccctgtctgtactaaaaatacaaaaattaggcgggcatggtagcacgtgtctgtaatcccagctcctcaggaggctgaggcagaagaatctcttgagcctgggaggcagaggttgcagtaagctgagatcacatcattgcactccagcctgggtgacagagcaagactctgtctcaaaaaaaaaaaaagaaagaaaaaagaaaatacagtgaactccagatgccactggaacatgggttccagcagcctggccaagctatgtgtcattctttttcctcatgatacccaggatgggctttgtgaggaggcactgtgccgttccagtggctttctgttacagctggccacaccatacaagcaagtacatcatctgcatgcactgctcctcacaggagcttgcacttcattcatatttattctgccctcatttaaggtataagcttagtgtcctaatatatttatttttggaaagggccaagttacaaaacatcttttttttgaggctgcactgttgatatgtcatgcagtggccaccaagaaagtatatactcgtgttagatactgattacatcatttacatcacgctcagtatttggaattaaagatgtgaatgttctgtgaccagagtagggatgacacaaatggaatcagctcctggtggactaagaatcttgaaaaaatctggccacctcatccactacatctggattgagtgtactgcaacaaagaaaaacattaaacaattttatattaaaagaa

SEQ ID NO: 127738 - DNA, 571 bp, Homo sapiens
  Payload ID: 5002
  Gene Symbol: DNAJC18
  Gene Name: DnaJ (Hsp40) homolog, subfamily C, member 18
  ENST ID: ENST00000505568
  CDS Start-End: 57-191
ctctttcagcctcgggcacgggggaggctcggcggacctgctgattgggaaccgatatggcggcgactctgggcagcggggagcgctggacggaaggatcaagaaatgcagaaattactatgaaattctgggagtttctcgagatgctagtgacgaagagcttaagaaagcttacagaaaactcgccctgaaatttcaccctgacaagaactgtgctcctggagcaacagatgctttcaaagcaataggaaatgcatttgcagtcctgagcaatcctgataagagacttcgctatgatgaatacggagatgaacaggtgactttcactgcccctcgagccagaccttataattattacagggattttgaagctgacatcactccagaagagctgttcaacgtcttctttggaggacattttcctacaggaaatattcatatgttttcaaatgtgacagatgacacttactattaccgtcgacggcaccgacatgagaggacacagactcagaaggaggaggaagaagagaaacctcagactacatattctgcatttattcagctacttcca

SEQ ID NO: 127739 - DNA, 1046 bp, Homo sapiens
  Payload ID: 5002
  Gene Symbol: DNAJC18
  Gene Name: DnaJ (Hsp40) homolog, subfamily C, member 18
  ENST ID: ENST00000515581
  CDS Start-End: 503-1046
gttgttattctgcctgccatgggcactgagtacagctgctcatcatactggactaatcaggtcaaggacatggggcttcattctaagtaactcagctgtcatcttcattataaaaccacacattttcctctgactctgggcaatgacctgcgtatataagctgttagtcataagggctggatggggcagcatctcaatcatatagggcacaggacagacctcagtatcaccagcaagaatccattacagttcaacatgtagtacctccagaccttttccctgtgcccctggactccaaggtctatcccaccctcagctgtccatcttctagagcaggcggtctagcctccccaaaccagaagaacttcctttttatattcaaccacctgatggatgtccctgatcagttccctcagctgcagagcacaagaaggaccttcaggatccagctttctcctcgggcacgggggaggctcggcggacctgctgattgggaaccgatatggcggcgactctgggcagcggggagcgctggacggaagcttacattgacgcagttagaagaaacaaatacccagaagacacacctcctgagagtcatgacccctgtggctgctgtaactgcatgaaggcacaaaaggaaaagaagtctgagaatgagtggactcagacccggcagggtgaggggaactccacgtatagtgaggaacagctgcttggggtacaaaggatcaagaaatgcagaaattactatgaaattctgggagtttctcgagatgctagtgacgaagagcttaagaaagcttacagaaaactcgccctgaaatttcaccctgacaagaactgtgctcctggagcaacagatgctttcaaagcaataggaaatgcatttgcagtcctgagcaatcctgataagagacttcgctatgatgaatacggagatgaacaggtgactttcactgcccctcgagccagaccttataattattacagggattttgaagctgacatcactccagaagagctgttcaacgtcttctttggag

SEQ ID NO: 127740 - DNA, 432 bp, Homo sapiens
  Payload ID: 5002
  Gene Symbol: DNAJC18
  Gene Name: DnaJ (Hsp40) homolog, subfamily C, member 18
  ENST ID: ENST00000514052
  CDS Start-End: 1-365
agaggacacagactcagaaggaggaggaagaagagaaacctcagactacatattctgcatttattcagctacttccagttcttgtgattgtgattatatctgtcattactcagctgctggctactaatcccccatatagtctgttctataaatcgaccttgggctacaccatttctagagaaactcagaacctgcaggtgccttactttgtggataaaaactttgacaaggcctacagaggagcttctctgcatgacttggagaaaacaatagagaaggattacattgattatatccagactagttgttggaaggagaaacaacaaagaggtacccttttaactgaagttttggctcatgtttaaaaagcaaattctgactcatttctaaagccttattactgagtatcattaaatacctaatggagtctga

SEQ ID NO: 127741 - DNA, 832 bp, Homo sapiens
  Payload ID: 5002
  Gene Symbol: DNAJC18
  Gene Name: DnaJ (Hsp40) homolog, subfamily C, member 18
  ENST ID: ENST00000515277
  CDS Start-End: 314-832
gtttgtgctgttgttattctgcctgccatgggcactgagtacagctgctcatcatactggactaatcaggtcaaggacatggggcttcattctaagtaactcagctgtcatcttcattataaaaccacacattttcctctgactctgggcaatgacctgcgtatataagctgttagtcataagggctggatggggcagcatctcaatcatatagggcacaggacagacctcagtatcaccagcaagaatccattacagttcaacatcctcgggcacgggggaggctcggcggacctgctgattgggaaccgatatggcggcgactctgggcagcggggagcgctggacggaagcttacattgacgcagttagaagaaacaaatacccagaagacacacctcctgagagtcatgacccctgtggctgctgtaactgcatgaaggcacaaaaggaaaagaagtctgagaatgagtggactcagacccggcagggtgaggggaactccacgtatagtgaggaacagctgcttggggtacaaaggatcaagaaatgcagaaattactatgaaattctgggagtttctcgagatgctagtgacgaagagcttaagaaagcttacagaaaactcgccctgaaatttcaccctgacaagaactgtgctcctggagcaacagatgctttcaaagcaataggaaatgcatttgcagtcctgagcaatcctgataagagacttcgctatgatgaatacggagatgaacaggtgactttcactgcccctcgagccagaccttataattattacagggattttgaagctgacatcactccagaa

SEQ ID NO: 127742 - DNA, 652 bp, Homo sapiens
  Payload ID: 5002
  Gene Symbol: DNAJC18
  Gene Name: DnaJ (Hsp40) homolog, subfamily C, member 18
  ENST ID: ENST00000508445
  CDS Start-End: 1-534
gctgacatcactccagaagagctgttcaacgtcttctttggaggacattttcctacaggaaatattcatatgttttcaaatgtgacagatgacacttactattaccgtcgacggcaccgacatgagaggacacagactcagaaggaggaggaagaagagaaacctcagactacatattctgcatttattcagctacttccagttcttgtgattgtgattatatctgtcattactcagctgctggctactaatcccccatatagtctgttctataaatcgaccttgggctacaccatttctagagaaactcagaacctgcaggtgccttactttgtggataaaaactttgacaaggcctacagaggagcttctctgcatgacttggagaaaacaatagagaaggattacattgattatatccagactagttgttggaaggagaaacaacaaaggttctggcacagtccttgcttcagaacaagtgctcaacaaatgtcttttgaagagaggattctcaggagtagaaaacaatgaaaatgctgaggattgtgaataacaacagcaggagtcagagctgacaaatttggcaggattatacagagatgaacgattgaaacagaaagcagagtcgctgaaacttgaaaactgtgag

SEQ ID NO: 127743 - DNA, 579 bp, Homo sapiens
  Payload ID: 5002
  Gene Symbol: DNAJC18
  Gene Name: DnaJ (Hsp40) homolog, subfamily C, member 18
  ENST ID: ENST00000512473
  CDS Start-End: 504-579
gttattctgcctgccatgggcactgagtacagctgctcatcatactggactaatcaggtcaaggacatggggcttcattctaagtaactcagctgtcatcttcattataaaaccacacattttcctctgactctgggcaatgacctgcgtatataagctgttagtcataagggctggatggggcagcatctcaatcatatagggcacaggacagacctcagtatcaccagcaagaatccattacagttcaacatgtaagtagtacctccagaccttttccctgtgcccctggactccaaggtctatcccaccctcagctgtccatcttctagagcaggcggtctagcctccccaaaccagaagaacttcctttttatattcaaccacctgatggatgtccctgatcagttccctcagctgcagagcacaagaaggaccttcaggatccagctttctcctcgggcacgggggaggctcggcggacctgctgattgggaaccgatatggcggcgactctgggcagcggggagcgctggacggaagcttacattgacgcagttagaagaaacaaatacccag

SEQ ID NO: 127744 - DNA, 537 bp, Homo sapiens
  Payload ID: 5002
  Gene Symbol: DNAJC18
  Gene Name: DnaJ (Hsp40) homolog, subfamily C, member 18
  ENST ID: ENST00000506870
  CDS Start-End: 15-278
gattgggaaccgatatggcggcgactctgggcagcggggagcgctggacggaagcttacattgacgcagttagaagaaacaaatacccagaagacacacctcctgagagtcatgacccctgtggctgctgtaactgcatgaaggcacaaaaggaaaagaagtctgagaatgagtggactcagacccggcagggtgaggggaactccacgtatagtgaggaacagctgcttggggtacaaagcaataggaaatgcatttgcagtcctgagcaatcctgataagagacttcgctatgatgaatacggagatgaacaggtgactttcactgcccctcgagccagaccttataattattacagggattttgaagctgacatcactccagaagagctgttcaacgtcttctttggaggacattttcctacaggaaatattcatatgttttcaaatgtgacagatgacacttactattaccgtcgacggcaccgacatgagaggacacagactcagaaggaggaggaagaagagaaacctcag

SEQ ID NO: 127745 - DNA, 451 bp, Homo sapiens
  Payload ID: 5002
  Gene Symbol: DNAJC18
  Gene Name: DnaJ (Hsp40) homolog, subfamily C, member 18
  ENST ID: ENST00000515559
  CDS Start-End: 1-92
gagatgaacgattgaaacagaaagcagagtcgctgaaacttgaaaactgtgagaaactttccaaactcattggcctacgcagaggtggctgagaggataatggtcctacgcagggctggggttttgctacttgttcctatttatgttcctgattccattttataatacaaaactagaatgtggcaaaactggcagcttccatttttgtacttggagggaagccagctaccatgtaaattcaactacctgagaccactacactaaccaaaggagaagccatgcagaagagaacccagcaaccaagctgacagcaagaactgaggacccaaacacataattcaagttgagccatttgtgttaccccagatgatgggcagagcagaaatgtgctgccccaccaagtcctgctcagtctgcagaattgtgagcaaataataaaatgattgcagcc

SEQ ID NO: 127746 - DNA, 1453 bp, Homo sapiens
  Payload ID: 5003
  Gene Symbol: DNAJC19
  Gene Name: DnaJ (Hsp40) homolog, subfamily C, member 19
  Uniprot ID: Q96DA6
  ENST ID: ENST00000382564
  CDS Start-End: 172-522
cgacagttttccggcctagtttgcggctgctcctgccgtgttgcgtagggcgcctgtgcttgaggttgggggttgcgtcgctctctggtaaaggcgtgcaggtgttggccgcggcctctgagctgggatgagccgtgctcccggtggaagcaagggagcccagccggagccatggccagtacagtggtagcagttggactgaccattgctgctgcaggatttgcaggccgttacgttttgcaagccatgaagcatatggagcctcaagtaaaacaagtttttcaaagcctaccaaaatctgccttcagtggtggctattatagaggtgggtttgaacccaaaatgacaaaacgggaagcagcattaatactaggtgtaagccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtaaatgtatgatgaattttaagttcgtattagtttatgtatatgagtactaagtttttataataaaatgcctcagagctacaattttaaaaaatgatttagcacaagctaaatctcaaagccttggtataattttcttgtttaaatttggggattttaaatcagattatagtttagaatatttgcgtattaattatgggcaagcacacaccttctgaatagaaatattgttcattactcatttagcagataatttgggacctatgtctacttttcaaggcaaagtgaagatgacagtccttgctctcagggagcccccactttaatgggagactgataaactggtaattagactgtgataaatagtatgatggaaattagcttaagctgtttaagtagggactcttcttattcggtggaaaggctgttccaggtacaggcaactggcctggcaacttggatacttggaaccttgtatttaaaagtgaatttaaccacaactgagacctaagaaattgacctaggggtgtgtgtgtgtgtgtattctatgtacatataaaccatttttatttcatgcattaaaaatagtatgataaagatttcagagtacaggtctggtacaatcacagttcattgcagcctcaacctcctgggtttaagcagtcctcccgcctcagcctcccaaagtactgggattacaggcatgagtatttacattgtattcagctagccccttaaaggtaatgaccatttataaattattccttcagttggctatttcttgacataatcaaacttctgcaattgttatgattaagcttaaaccctgttagcaaaactgaaaactgaaatgttctcaatatcaacatatttaatttggactctttagaatttatacactaataaatttaaatgatgtttaaaggcaaa

SEQ ID NO: 127747 - DNA, 1239 bp, Homo sapiens
  Payload ID: 5003
  Gene Symbol: DNAJC19
  Gene Name: DnaJ (Hsp40) homolog, subfamily C, member 19
  ENST ID: ENST00000469657
  CDS Start-End: 102-245
ggttgcgtcgctctctggtaaaggcgtgcaggtgttggccgcggcctctgagctgggatgagccgtgctcccggtggaagcaagggagcccagccggagccatggccagtacagtggtagcagttggactgaccattgctgctgcaggatttgcaggccgttacgttttgcaagccatgaagcatatggagcctcaagtaaaacaagtttttcaaagcctaccaaaatctccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtaaatgtatgatgaattttaagttcgtattagtttatgtatatgagtactaagtttttataataaaatgcctcagagctacaattttaaaaaatgatttagcacaagctaaatctcaaagccttggtataattttcttgtttaaatttggggattttaaatcagattatagtttagaatatttgcgtattaattatgggcaagcacacaccttctgaatagaaatattgttcattactcatttagcagataatttgggacctatgtctacttttcaaggcaaagtgaagatgacagtccttgctctcagggagcccccactttaatgggagactgataaactggtaattagactgtgataaatagtatgatggaaattagcttaagctgtttaagtagggactcttcttattcggtggaaaggctgttccaggtacaggcaactggcctggcaacttggatacttggaaccttgtatttaaaagtgaatttaaccacaactgagacctaagaaattgacctaggggtgtgtgtgtgtgtgtattctatgtacatataaaccatttttatttcatgcattaaaaatagtatgataaagatttcagagtacaggtctggtacaatcacagttcattgcagcctcaacctcctgggtttaagcagtcctcccgcctcagcctcccaaagtactgggattacaggcatgagtatttacattgtattcagctagccccttaaaggtaatgaccatttataaattattccttcagttggctatttcttgacataatcaaacttctgcaattgttatgattaagcttaaaccctgttagcaaaactgaaaactgaaatgttctcaatatcaa

SEQ ID NO: 127748 - DNA, 610 bp, Homo sapiens
  Payload ID: 5003
  Gene Symbol: DNAJC19
  Gene Name: DnaJ (Hsp40) homolog, subfamily C, member 19
  Uniprot ID: Q96DA6
  ENST ID: ENST00000479269
  CDS Start-End: 260-535
aagttgtgctccttagtgcgactgcgggcgggaggtttcggttattggggagtcacactcaccaggacacaaccctgttggctcgctctcttgggggtttgtgtttttacatcgtctttctgcacggttctccagcttcttgtccgcacgggctctgcaggtgttgcttgcctggaactcctgtaaggccagtacagtggtagcagttggactgaccattgctgctgcaggatttgcaggccgttacgttttgcaagccatgaagcatatggagcctcaagtaaaacaagtttttcaaagcctaccaaaatctgccttcagtggtggctattatagaggtgggtttgaacccaaaatgacaaaacgggaagcagcattaatactaggtgtaagccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtaaatgtatgatgaattttaagttcgtattagtttatgtatatgagtactaagtttttataataaaatgcctc

SEQ ID NO: 127749 - DNA, 828 bp, Homo sapiens
  Payload ID: 5003
  Gene Symbol: DNAJC19
  Gene Name: DnaJ (Hsp40) homolog, subfamily C, member 19
  ENST ID: ENST00000486355
  CDS Start-End: 168-347
agttttccggcctagtttgcggctgctcctgccgtgttgcgtagggcgcctgtgcttgaggttgggggttgcgtcgctctctggtaaaggcgtgcaggtgttggccgcggcctctgagctgggatgagccgtgctcccggtggaagcaagggagcccagccggagccatggccagtacagtggtagcagttggactgaccattgctgctgcaggatttgcaggccgttacgttttgcaagccatgaagcatatggagcctcaagtaaaacaagtttttcaaagcctaccaaaatctgccttcagtggtggctattatagagccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtaaatgtatgatgaattttaagttcgtattagtttatgtatatgagtactaagtttttataataaaatgcctcagagctacaattttaaaaaatgatttagcacaagctaaatctcaaagccttggtataattttcttgtttaaatttggggattttaaatcagattatagtttagaatatttgcgtattaattatgggcaagcacacaccttctgaatagaaatattgttcattactcatttagcagataatttgggacctatgtctacttttcaaggcaaagtgaagatgacagtccttgctctcagggagcccccactttaatgggagactgataaactggtaattagactgtgataaat

SEQ ID NO: 127750 - DNA, 769 bp, Homo sapiens
  Payload ID: 5003
  Gene Symbol: DNAJC19
  Gene Name: DnaJ (Hsp40) homolog, subfamily C, member 19
  Uniprot ID: Q96DA6
  ENST ID: ENST00000491873
  CDS Start-End: 132-407
ggttgggggttgcgtcgctctctggtaaaggcgtgcaggtgttggccgcggcctctgagctgggatgagccgtgctcccggtggaagcaagggagcccagccggagccatggccgttacgttttgcaagccatgaagcatatggagcctcaagtaaaacaagtttttcaaagcctaccaaaatctgccttcagtggtggctattatagaggtgggtttgaacccaaaatgacaaaacgggaagcagcattaatactaggtgtaagccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtaaatgtatgatgaattttaagttcgtattagtttatgtatatgagtactaagtttttataataaaatgcctcagagctacaattttaaaaaatgatttagcacaagctaaatctcaaagccttggtataattttcttgtttaaatttggggattttaaatcagattatagtttagaatatttgcgtattaattatgggcaagcacacaccttctgaatagaaatattgttcattactcatttagcagataatttgggacctatgtctacttttcaaggcaaagtgaagatgacagtccttgctctcagggagcccccactttaatgggagactgataaactggtaattagactgtgata

SEQ ID NO: 127751 - DNA, 1846 bp, Homo sapiens
  Payload ID: 5004
  Gene Symbol: DNAJC2
  Gene Name: DnaJ (Hsp40) homolog, subfamily C, member 2
  Uniprot ID: Q99543
  ENST ID: ENST00000249270
  CDS Start-End: 45-1751
gggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaagatgggaagttattgctaattacatgaacatacattcttcctctggagtcaaaagaactgccaaagatgttattggcaaagcaaagagtctccaaaaacttgaccctcatcaaaaagatgacataaataaaaaggcatttgataagttcaaaaaagaacatggagtggtacctcaagcagacaacgcaacgccttcagaacgatttgaaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgtaaacattttcattcttaaaattatactcatggtaataatttgaaagta

SEQ ID NO: 127752 - DNA, 942 bp, Homo sapiens
  Payload ID: 5004
  Gene Symbol: DNAJC2
  Gene Name: DnaJ (Hsp40) homolog, subfamily C, member 2
  ENST ID: ENST00000379257
  CDS Start-End: 177-680
acaccacgaaagatccatcccggaagtgcttactggtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaaggatccccaggtgattcttatcagaagctcatcctacagttaattcatcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatg

SEQ ID NO: 127753 - DNA, 2167 bp, Homo sapiens
  Payload ID: 5004
  Gene Symbol: DNAJC2
  Gene Name: DnaJ (Hsp40) homolog, subfamily C, member 2
  Uniprot ID: Q99543
  ENST ID: ENST00000379263
  CDS Start-End: 252-2117
agccggatctcagtcagtatagaactaggttaccgcacacgttggcgggggtgggagggtgtgagactggcctccacaccacgaaagatccatcccggaagtgcttactggtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagacctggaatcatttttctgataatgaggcagagcgggttaaaatgatggaagaagtggaaaaactttgtgatcggcttgaactggcaagcttacagtgcttgaatgaaacactcacatcatgcacaaaagaagtaggaaaggctgctttggaaaaacagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaagatgggaagttattgctaattacatgaacatacattcttcctctggagtcaaaagaactgccaaagatgttattggcaaagcaaagagtctccaaaaacttgaccctcatcaaaaagatgacataaataaaaaggcatttgataagttcaaaaaagaacatggagtggtacctcaagcagacaacgcaacgccttcagaacgatttgaaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgtaaa

SEQ ID NO: 127754 - DNA, 854 bp, Homo sapiens
  Payload ID: 5004
  Gene Symbol: DNAJC2
  Gene Name: DnaJ (Hsp40) homolog, subfamily C, member 2
  ENST ID: ENST00000454277
  CDS Start-End: 290-854
cggaagtgcttactggtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacagagcaacaagagcacaaagaaaaaaagaagaaa

SEQ ID NO: 127755 - DNA, 3033 bp, Homo sapiens
  Payload ID: 5004
  Gene Symbol: DNAJC2
  Gene Name: DnaJ (Hsp40) homolog, subfamily C, member 2
  ENST ID: ENST00000412522
  CDS Start-End: 209-565
ggcgggggtgggagggtgtgagactggcctccacaccacgaaagatccatcccggaagtgcttactggtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcgtaagtacttagttattttgaaataatcaaatatcttgtataggaacaggctggctatgctttttaaaagatatacagtatcatagtctgcagccataactacatttaacagcatgtgttatattgtcataacaagcaaaaaaccacggtctcccctgccttcagaatcagaagaaagcaatccattttacatatagactttcccattagggataagaaattaggatgggtgtgtgtgtgtggatacaaaatactcctccaatggcaagcttttaaaaaataatacttcacctctctttagaagtatagcagctgcacttagtggatactgcctttttattgttttttggtttttggttttttttttacgttattttgtaatcttaggtcacacctttgtagatatcaccctgtcttctgtccaagaaaagttgtctgatgttttattgttgttttcattgacaaggttataatttggcatgggagagggtaatgttgggaccccagtcttcatatgccttataaaacaccatcccttaatgctcctaaatgtcctatgctttgcaatcctgtggacataatttcttatacacgtgatcagttcaactgattaataaagtttagtgaaagaggtaagaggtgaaggtgatcagttttctatcttaggagaatgttctgccctccactctagagaatggatattgaggtcagagagggtaagattgtggccacatggaaaaggagcagggagtcagggcctgtcaagaagaggaagtattatatgtggaggaagatgactgaataagaatgcctgtggtaaaaattattagtcaatacttagcatagtagatgaactcaaaatcgtccccattactgcttacatttaggaaaatcacaggaaatattttttaacaaagtgaaggaatttatcagattattttaaactggatttgtttaaaggctggcatgagtctagacaaagcatatggtaatgcatgtgaatagttattccagtataaataaatgccagaaaagtccatttgccacgtacaagtgtttgcaaagttttactatacgaaagaatagcattggccgggcgtggtggctcacgcctataatcccaacactttgggaggccgagacgggttgatcacctgaggtgaggaatatgagaccagcctggccaacgtggagaaacaccgtctctactaaaaatacaaaaaaattagctgggtgtggtggtgggcacctgtattcccagctacttgggaggctgaggcaggagaattgcttgaacccaggaggcagaggttgcagtgagccgaggtcgcaccattgcgctccagcctgggcaacaagagcgacactctgtttccgaaaaaatagaatagcatacaaataccaaatatgtcttagtacagataaatttgttaattagaattgataatagaactgtgagaatagtttgtgttttaaggtgaaagaattctttctcagaagattaaaaatgtgcaataaattgtaaaagaagcattcatatgcttctgttaaatccactgtctttttttgagacagaatttcgtacttgttgcgcaggctggagtgcaatggcaccatcttggctcaccacaacctccgcctcccaggttcaagcgattctcctgcctcagcctcttgagtagctgggattagaggcatgtgccaccacgcccggctaattttgtatttttcatagagacgggatttcaccatgttggtcaggctggtctcgaactcccgacctcaggtgatccacccacatcggcctcccagaatgctgggattacaggcgtgagccaccgcacccagcctaaatccactctttttattggccttgtagaaattgatttttagccaggcacagtgggtcacacctgtaatcccaacactttggaagaccaaggcaggcagattacttgaggctggagttcaatactagcccggccaatgtggtgaaaccccatctctactaaaaatacaaaaattagccaggtgcggtggcgcatgcctgtaagcccaactacttgggaggctgaggcatgagaatcgcttgaacctgggaggcggaagttgcagtgagcgaagattgtaccactgcagtccaacctgagcaacagagtgagagagtgagactctgtctcattaaaaaaaaaaaaaagaaagaaagaaagaaaagaaattcagcttttgaatatgtattctctagccaaaaattttgcagcaccagtgtagagattgttaacaataagggtaattctaacttactctctaccacccttgtggaatattccgtcagtctttatttagaaagaaactgtcattctctcacctctgtcactgtaaaacacagttgctactcattgctttctgaaaatctatctaaaagttaaaatgcaaagttactgtttgcaaatctataattattagcacaaacctaataaaaatgtaaatctgg

SEQ ID NO: 127756 - DNA, 729 bp, Homo sapiens
  Payload ID: 5004
  Gene Symbol: DNAJC2
  Gene Name: DnaJ (Hsp40) homolog, subfamily C, member 2
  ENST ID: ENST00000426036
  CDS Start-End: 1-729
gcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccaggtataattttgattcttggagagaattttcttatttagatgaagaagaaaaagaaaaagcagaatgtcgtgatgagaggagatggattgaaaagcagaacagagcaacaagagcacaaagaaaaaaagaagaaatgaacagaataagaacattagttgacaatgcatacagctgtgatccaaggataaaaa

SEQ ID NO: 127757 - DNA, 2309 bp, Homo sapiens
  Payload ID: 5005
  Gene Symbol: DNAJC21
  Gene Name: DnaJ (Hsp40) homolog, subfamily C, member 21
  Uniprot ID: Q5F1R6
  ENST ID: ENST00000342382
  CDS Start-End: 228-1823
gcgctcccgcttgccgcagcctgcgtcgtctgccgccaccgcgcgccttcactgacctacaccaccgccgccgccgccgccgccgccgggctcgctggctggcccggtgcgggcggcggactcccgccggagaggactgccagcgccgccgccgccgccgcttcggcccgggcccgggccccgaccccgtcccgggccccagcgccggccgcccgcccggtcgggcgatgaagtgtcactatgaggcgctgggggtgcggcgcgacgccagcgaggaggagctcaagaaggcctatcggaagctggccctgaaatggcacccggataaaaatctggataatgccgcagaagcagctgaacaatttaaattaatccaagcagcatatgatgtgttgagtgaccctcaggaaagagcatggtatgataatcatagagaggccctacttaaaggtgggtttgatggcgaatatcaagatgacagcttagatttgctacgctatttcaccgttacctgttattctggttatggagatgatgaaaagggattttacacggtgtatcgtaatgtttttgaaatgattgccaaggaagaactagaatctgtgttagaggaagaggttgatgatttcccaacttttggagactcccagagtgactatgatacggtagtccatcctttctacgcttattggcagagtttctgcactcaaaagaattttgcatggaaggaagaatatgatacacgacaggcttcaaaccgctgggaaaaacgagccatggaaaaagaaaacaaaaagattcgggacaaagcaaggaaagagaagaatgagcttgtccgtcagctggtagctttcattcgtaaaagagataaaagagtgcaggcgcatcgaaaacttgtggaagaacagaatgcagagaaggcgaggaaagccgaagagatgaggcggcagcagaagctaaagcaggccaaactggtggagcagtacagagaacagagctggatgactatggccaatttggagaaagagctccaggagatggaggcacggtacgagaaggagtttggagatggatcggatgaaaatgaaatggaagaacatgaactcaaagatgaggaggatggtaaagacagtgatgaggccgaggacgctgagctctatgatgacctttactgcccagcatgtgacaaatcgttcaagacagaaaaggccatgaagaatcacgagaagtcaaagaagcatcgggaaatggtggccttgctaaaacaacagctggaggaggaagaagaaaatttttcaagacctcaaattgatgaaaatccattagatgacaattctgaggaagaaatggaagatgcaccaaaacaaaagctttctaaaaaacagaagaaaaagaaacagaaaccagcacagaattatgatgacaatttcaatgtaaatggacctggagaaggagtaaaggttgatccagaagatactaacttaaatcaagacagtgccaaagaattggaagatagtccccaggaaaatgtcagtgtcacagagatcattaaaccatgtgatgatccaaaaagtgaagctaaaagtgttcctaaacccaaaggaaagaaaaccaaagatatgaaaaaacctgtcagagtacctgctgaaccacaaacaatgagtgttcttatcagctgtacaacctgccatagtgaatttccatctcggaataaactttttgaccatctaaaggccacaggtcatgcaagagcaccttcatcatcgtctttaaacagcgcaacaagtagtcaaagcaagaaagagaaacgtaaaaacagatagagattctgcctgtgcttttgtttgactgtctctagattttgaaaccaaaaaactgaactgaaatcatctaaagagttaaaatttcagtgatctgcaattaattacattgtggaagattattttttatcttgtaaaaacacttttttggtttaatatatatttttaaaacatttcactagtgattgaattctacttttgccatctgaattgacttgaatgtcttaaaacaggtaaatactgtaaagtgtgtattcttgatgtttattggctcatgtggacagaaatgtacagggagaattacattattttaacacacagaagtgcaactttctgctttattttctgaatttcacattacttttacttaatgcttttgtgttttgttaatacttcataatatgtgaaaaactcggatcttttaaaaagcatcatagatcatttttccatatgacactggttccgattttaaaaattatttttaaataa

SEQ ID NO: 127758 - DNA, 6208 bp, Homo sapiens
  Payload ID: 5005
  Gene Symbol: DNAJC21
  Gene Name: DnaJ (Hsp40) homolog, subfamily C, member 21
  Uniprot ID: Q5F1R6
  ENST ID: ENST00000382021
  CDS Start-End: 228-1958
gcgctcccgcttgccgcagcctgcgtcgtctgccgccaccgcgcgccttcactgacctacaccaccgccgccgccgccgccgccgccgggctcgctggctggcccggtgcgggcggcggactcccgccggagaggactgccagcgccgccgccgccgccgcttcggcccgggcccgggccccgaccccgtcccgggccccagcgccggccgcccgcccggtcgggcgatgaagtgtcactatgaggcgctgggggtgcggcgcgacgccagcgaggaggagctcaagaaggcctatcggaagctggccctgaaatggcacccggataaaaatctggataatgccgcagaagcagctgaacaatttaaattaatccaagcagcatatgatgtgttgagtgaccctcaggaaagagcatggtatgataatcatagagaggccctacttaaaggtgggtttgatggcgaatatcaagatgacagcttagatttgctacgctatttcaccgttacctgttattctggttatggagatgatgaaaagggattttacacggtgtatcgtaatgtttttgaaatgattgccaaggaagaactagaatctgtgttagaggaagaggttgatgatttcccaacttttggagactcccagagtgactatgatacggtagtccatcctttctacgcttattggcagagtttctgcactcaaaagaattttgcatggaaggaagaatatgatacacgacaggcttcaaaccgctgggaaaaacgagccatggaaaaagaaaacaaaaagattcgggacaaagcaaggaaagagaagaatgagcttgtccgtcagctggtagctttcattcgtaaaagagataaaagagtgcaggcgcatcgaaaacttgtggaagaacagaatgcagagaaggcgaggaaagccgaagagatgaggcggcagcagaagctaaagcaggccaaactggtggagcagtacagagaacagagctggatgactatggccaatttggagaaagagctccaggagatggaggcacggtacgagaaggagtttggagatggatcggatgaaaatgaaatggaagaacatgaactcaaagatgaggaggatggtaaagacagtgatgaggccgaggacgctgagctctatgatgacctttactgcccagcatgtgacaaatcgttcaagacagaaaaggccatgaagaatcacgagaagtcaaagaagcatcgggaaatggtggccttgctaaaacaacagctggaggaggaagaagaaaatttttcaagacctcaaattgatgaaaatccattagatgacaattctgaggaagaaatggaagatgcaccaaaacaaaagctttctaaaaaacagaagaaaaagaaacagaaaccagcacaggatgtacctggcaaagattcatatctgcctgcagctcactttcagatggcttggggaaaaaagtgtgtgttgggagagagaagagatggagagagcgagcacaaatgtgccaaaatgttgcttgaaaacagacagaattatgatgacaatttcaatgtaaatggacctggagaaggagtaaaggttgatccagaagatactaacttaaatcaagacagtgccaaagaattggaagatagtccccaggaaaatgtcagtgtcacagagatcattaaaccatgtgatgatccaaaaagtgaagctaaaagtgttcctaaacccaaaggaaagaaaaccaaagatatgaaaaaacctgtcagagtacctgctgaaccacaaacaatgagtgttcttatcagctgtacaacctgccatagtgaatttccatctcggaataaactttttgaccatctaaaggccacaggtcatgcaagagcaccttcatcatcgtctttaaacagcgcaacaagtagtcaaagcaagaaagagaaacgtaaaaacagatagagattctgcctgtgcttttgtttgactgtctctagattttgaaaccaaaaaactgaactgaaatcatctaaagagttaaaatttcagtgatctgcaattaattacattgtggaagattattttttatcttgtaaaaacacttttttggtttaatatatatttttaaaacatttcactagtgattgaattctacttttgccatctgaattgacttgaatgtcttaaaacaggtaaatactgtaaagtgtgtattcttgatgtttattggctcatgtggacagaaatgtacagggagaattacattattttaacacacagaagtgcaactttctgctttattttctgaatttcacattacttttacttaatgcttttgtgttttgttaatacttcataatatgtgaaaaactcggatcttttaaaaagcatcatagatcatttttccatatgacactggttccgattttaaaaattatttttaaataaccgattattgattactgtattttttttctcaagaacagtgataggtagaaactaattgaacatttggtagtctttcaagaatagtgtctcttcaaggttttacttgatttaatttgatattttactggtttaccagtaaggtgtattgttcagttttttgctccgatttgaattgtggaggtggaagcaaattagtttacatggcatgtcctccctaggcacagtgacagctgtaaagtatgacggaacaaggtagcagatggtacagaatttatactatttaagaagagatgtggtgttcttcattgagtttttttcttcactattttcagaagtttttgttcttttttttttttccatcactcagtggagaaaagctttgttaatgaaagattttgtgatagagctgatgcttatacatctattctataacagtgatgaatattaacacaaaggaaatatggagaactgttataactgagtgttagaacagtcgtgtacattgatcagtattgagtccatttttaggatggattagtcagttcttttcattggtcttgaaagtaattttggctggtcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaagtaattttaaactcactggcttgaaatgtgtgctttctgtacaatgaagttattgctttccatatatccttgaatcttcagattaacgaaatgaacaaattttcggttacagatcagctctcaaacactaaagtccttaatggcaaggtcttttctgatagcttcatggatagtattgatgatcagatttcttctgtgttattgtcttaaaaataagcatttgaaccttaatttaaattcttttcttttccatttagagatatgtttttttctttaccttcatacctttctatttcttgctaatttctatcactaattccttataattgtccctgctccccttcttgatctcttcagggggaatactaggcagttttgtatcttctgatctcgtaccctgagacttcatctgaatgtgctctgccgccttcttatctgaactagatgaattggccataattatgaataggaatattaatgaaccagaggacatactagtcacatgttattatacactaaaaaataggaagtcatcttgaaaggcagttaatgtactgcaaatgtccctatgacttctttgctttctcttataccaaacatgcaggtatttaatttgtttaatgagggttgagtggagttatgtgtcgcttttattcggattgacgaaaatcaaccataattttcaagggatcttcatgggttgtgactggaagctgaccttagtcttgcgtctcatcctttatgatgttgagaaatcatctaatttctcagaactttttcttatctctaacacagttattaccataataatattgtctccatttatcatacaggatcattatgaaagtaaaatgaagtagtatatatgaaaatgctttttaaacacaaaagctttatacaaaatattgttgaatttaaataaggtaaatcttttttagtttatatatttgcagactatacatgttggattaaatgggcaattaagttttataggaatttgcttcctaagtctacttttgaagaggaaaacaggaacgtaccatatattttgctaagggtaaaatatttttggtgaattgcagacatttaatttcacttgtctgaggtaaaacaataaactaaaatacatgggcatgcatcttacactgatcttattagaggtcagtgctaagtacccatcttgattgaagttagctcagatgtggagattcatagaatgagggtccaggagaagaaagttaggggaaatctcattttctttctgtaattcattcagtggtgccaaagctgggggttccctacaatggctatttagactttccctgcttcaaaataagagcagtatccttagctctagccaagcatttttctaattcctgcctttggtcacaaagaaggaaaagcagagctgtgaatgagttagtggaggtcaagtcacatcagagttcatgacctagtgattgctggtgaagtaatattggaattttggtaccatgagaagacttataaaggatttcatcagaagttttcattttttctaaatcctcccctacaaaattttcagattggaaattactcttgtatttgtagaagattgtctctaaaattgtggtttaactcacgcaggaagtaaaattcctatagcaagacatagtttcattttagaggacccccaaaatcccgtgaattctctggtgatgattctagcctaaccttcaacataaaataatgaagagaacttttaaacttttttatgaattcctaaacattaccatttatgtggcagaagttctgttccctataatctgcaatgctgaagtatctctattcaattcccttccttatctgttaaatttaatgtctttatactaaaaatataggctcttgggattggagaggaaaaattagaggtgattttcagatttcttgttctatggaagaggaagctgagctcagggagatatgagctccacagccacagctggttaggggcggctgccagtagaacagggcagatgcctggactcccaactcagtaggccttctgttacacctcaaaatgtgttacatgggaagaaaaagattaagaaaaagcaagataattttgaagaaggacgagaggaagaggcatgaacttgtcctaacaatgtcaaagaatattttaaaggtataccagttaaagtagtgtgtggctggtgccagtagaggtcagtcaagggatccctgacgagaataaagagcccagaaacaggtccatgtttatatgggaacttgatttttgacagatacggcaagctctatggggaaaacaatatgtactaccttatacccttccccaaaaacaaagggattaaagacctaaatatgaagacaaaacttttaaatgagaatctataaggttattttcatgattttgcaaatgggaaggatttctttaaagcaagacacaaaagcatacacaggaaaaaatgatgcataaaaacatggcttctgtagaacaatagagactgtaaaagaacaagctacagacaaggaaatgtttgcaatgcatggaactgtcaaaggattcgtatctggaatacattaaagaagcaaaagaacctcatacaaaagtcattgagtaaatgacagccatgcattagaacagcaattctcaaaacttttggtctcaagatccctttacactcttcaaaagtgagaaccccaaagagttttcatgtatgtgggttaaatctattgatattttctgttagaatttaaaaattatgttaaaaaaataagaagaatgactatttttcaaaacaaaaaatgagaagagtggtattgttttacatttttacaaatctctttaacatttagcttaataaaagatagctggcctctca

SEQ ID NO: 127759 - DNA, 2059 bp, Homo sapiens
  Payload ID: 5006
  Gene Symbol: DNAJC22
  Gene Name: DnaJ (Hsp40) homolog, subfamily C, member 22
  Uniprot ID: Q8N4W6
  ENST ID: ENST00000395069
  CDS Start-End: 622-1647
gggggacctcggagatccacgagattgccagagaaggaaattgaggcccaagaagctgcatgacttagccaagttcacggagtagaacccgggattggagcccgggacattgaaatgaaggcgtcttgcattgcagctccgttgcagcgcagaggcgcaggaaggcagactaccacgagcctcgggctgcggcctcgccctcctggtcgagcctcctgccctccaaccctctgctcccgtttctccctctggttcatagcccgcgggacagagcagccctggattgggaggctcctcaggtctcaggctcaggtgcagaagcagagcccctaactggaaggctcggaggtgggccggtgaggcaagcaagccctgtggggggttgaggacagcttgggttggatgtccctcactgcagcctgtccgtggatgtctctgccttaagggaattggaggtggaaccatccagtcttgaaggtcaacggagcgtgaagagaggagcgtgcagcttgagggtctaaggataactctggggccatgacagccatgagtctcacagaggaccccgagacttctgtgctgcgagtaaccggacttgttctgagacctttgccctagaggatggccaaggggctcctggtgacctatgccctctgggctgtggggggccctgctgggctccaccacctgtacctgggaagggacagccacgccctgctctggatgctgaccctggggggaggtgggctgggctggctctgggagttctggaagctcccaagctttgtagctcaggccaacagagcccagggacagaggcagagccccagaggggtgacaccccctctgagtcccattcgctttgctgcccaggtgatagttggcatctattttggccttgtggcactgattagcctttcttccatggtcaacttctatattgtggccctcccactggcagttggcttaggggtcttgctggtggctgctgttggcaaccagacctcagactttaagaacactctggggtcagcatttctcacttcacctatcttctatggccgccccatagccatactgcccattagcgtggccgccagcattacagctcagaggcatcgccgctacaaagctttggtggcatcagagccgctcagtgtgcggctctatcgtctgggcttggcttaccttgctttcacaggcccactggcatacagtgccctctgcaacacagctgccaccctcagctatgtggcagaaacctttggctccttcttgaattggttcagcttcttcccccttcttggccgcctcatggagtttgtcctccttctgccttaccggatctggaggctactgatgggggagactggcttcaacagcagctgctttcaggagtgggcgaagctctatgagtttgttcacagttttcaggatgagaagcgtcagctggcttaccaggttttgggcctctcagaaggggcaacaaatgaagaaatacatcggagttaccaggagctagtgaaggtctggcacccagaccacaacctggaccagacagaggaggcacagaggcacttcctggagatccaggctgcgtatgaagtcctgagtcaacccaggaagccctggggatcccggaggtgaaaagaaacttccccctgaggactgactcttcctagcagagctgggcaacttgtcccaaatctagctttgcccacgaatggcatcccaacagagttaaagaaactgcttgcaggggctgggcgtggtggctcatgcctgtaatcccagcactttgggaggccgaggcgggcagatcacgaggtcaggagttcgagaccagcagcctggccaatatagtgaaacttcgtctctactaaaaatacaaaaaattagccaggagtggtggcaggcacctgtagtcccagctacttgggaggctgaggcaggagaatcacctgaacctgagaggcggaggttgcagtgagccgagatcacgccactgcactccagcctgggcaacaagagtgaaactccgtctcaaaaaaaaaaaaaa

SEQ ID NO: 127760 - DNA, 4412 bp, Homo sapiens
  Payload ID: 5006
  Gene Symbol: DNAJC22
  Gene Name: DnaJ (Hsp40) homolog, subfamily C, member 22
  Uniprot ID: Q8N4W6
  ENST ID: ENST00000549441
  CDS Start-End: 1205-2230
agcatttcctctccaggccgagatgagggctgagggcgtttggagggaagcgctctgcctactgccgggaggtgacacccgcgaggccgaccgtcccccgaagcccccgcaagtccagactgggggacctcggagatccacgagattgccagagaaggaaattgaggcccaagaagctgcatgacttagccaagttcacggagtagaacccgggattggagcccgggacattgaaatgaaggcgtcttgcattgcagctccgttgcagcgcagaggcgcaggaaggcagactaccacgagcctcgggctgcggcctcgccctcctggtcgagcctcctgccctccaaccctctgctcccgtttctccctctggttcatagcccgcgggacagagcagccctggattgggaggctcctcaggtctcaggctcaggtgcagaagcagagcccctaactggaaggctcggaggtgggccggtgaggcaagcaagccctgtggggggttgaggacagcttgggttggatgtccctcactgcagcctgtccgtggatgtctctgccttaagggaattggaggtggaaccatccagtcttgaaggtcaacggagcgtgaagagaggagcgtgcagcttgagcactacagataggagcgtcccttgctcctgccaggcagcccctccataggggcagtcctgtgctgctgtgcctcggtacccgcacaaggtgtctggggaccgcccggacccccccttccatcggcggcagcgccacctggcggccatggtgcggtggtgtgggaggagctgggcccgggctgggcactgagcccaccggagctgcaggcgtctgcagagccttgcaccgagtttccccgcgagggcgggcgggaggagtcccaggcgggaatgtgatccccagggggccggggagggccctggggaggagcctggcctggggaagccggacttccgtgacacaacagacacaaaagacaaagtccatttggatggaagtgggagcagggcgagacgggccattttcactctgtggtcaaaggaaatgactggtctgactcggtctgggagcggggcacccagggtctaaggataactctggggccatgacagccatgagtctcacagaggaccccgagacttctgtgctgcgagtaaccggacttgttctgagacctttgccctagaggatggccaaggggctcctggtgacctatgccctctgggctgtggggggccctgctgggctccaccacctgtacctgggaagggacagccacgccctgctctggatgctgaccctggggggaggtgggctgggctggctctgggagttctggaagctcccaagctttgtagctcaggccaacagagcccagggacagaggcagagccccagaggggtgacaccccctctgagtcccattcgctttgctgcccaggtgatagttggcatctattttggccttgtggcactgattagcctttcttccatggtcaacttctatattgtggccctcccactggcagttggcttaggggtcttgctggtggctgctgttggcaaccagacctcagactttaagaacactctggggtcagcatttctcacttcacctatcttctatggccgccccatagccatactgcccattagcgtggccgccagcattacagctcagaggcatcgccgctacaaagctttggtggcatcagagccgctcagtgtgcggctctatcgtctgggcttggcttaccttgctttcacaggcccactggcatacagtgccctctgcaacacagctgccaccctcagctatgtggcagaaacctttggctccttcttgaattggttcagcttcttcccccttcttggccgcctcatggagtttgtcctccttctgccttaccggatctggaggctactgatgggggagactggcttcaacagcagctgctttcaggagtgggcgaagctctatgagtttgttcacagttttcaggatgagaagcgtcagctggcttaccaggttttgggcctctcagaaggggcaacaaatgaagaaatacatcggagttaccaggagctagtgaaggtctggcacccagaccacaacctggaccagacagaggaggcacagaggcacttcctggagatccaggctgcgtatgaagtcctgagtcaacccaggaagccctggggatcccggaggtgaaaagaaacttccccctgaggactgactcttcctagcagagctgggcaacttgtcccaaatctagctttgcccacgaatggcatcccaacagagttaaagaaactgcttgcaggggctgggcgtggtggctcatgcctgtaatcccagcactttgggaggccgaggcgggcagatcacgaggtcaggagttcgagaccagcagcctggccaatatagtgaaacttcgtctctactaaaaatacaaaaaattagccaggagtggtggcaggcacctgtagtcccagctacttgggaggctgaggcaggagaatcacctgaacctgagaggcggaggttgcagtgagccgagatcacgccactgcactccagcctgggcaacaagagtgaaactccgtctcaaaaaaaaaaaaaagaaagaaaaactgcttgcaggggacatgagaaaacaatggggtgagaaaaggttgtggtagaaggatgtgtttatattctgaatttctgaattcttggctattgcattcttgacaatttttcttaaaaccagagagtgaaaggcatattataaaacaatcaaatatcttttagagtatggacaactattatatatcaataaaaaattaattagaaaaaatatatcttttagagaacacaccaccttatcccacccatgatatattgatgtgtgatggagaaagattatttaactatttttttaaatgtgtaaagcagcagggcatagtggcttacgcctgtaatcccaacactttgggaagctgaggtgggaggatcaccttaggtcaggagttcaagaccagcctggccaaccaacatggtgaaaccccatctctactaaaaatacaaaacttagccagccatggtggcacatgcctgtagccccagctagtcgggaggctgaggcaggaaaatcacttgagcctgggaggtggaggttgcagtcaactgagattgagccactgcactgtactccagcctgggcggcagagctagattctgtctcaaaaattaaataaataaataagtaagtaaataaataaataaataaatgtataaagcactatgttaggagattgaaggaaaaatatgaaggttctagtattcacaagctgtcctgtgataagagagatttgatcttttctgtagatggggtgagactaggattaaatttcaaaatttgagaaaaatattttcattccatttatgggagaactttctagcagctacactttctccaaaagggaacaagctactgtggagtggggggtagttcttcctcctctgcttagaggagaatttttggagagctctcagactttacataggtgattggactggctgacttctcaggtcttcccagtatttgaggtctgattctgggctacataccctactcctagaagcatacaatctgatgggagataatgacacaggtacacagatatcaaagcccttgttcagtgttttgaactaaatgtcataagagctgtaaatagtgtattggcacattggaggagggacagataacattgttttatggggactcagaaagattcattattttatatgtcatatgtccctttggggactttgggaaaccctagggaaccagcggctagagcatctcaagggggccttattcaattctaggtaactagccaggtgtgaaagaaagggcccagggtgtctcactttgcagaggaagattggagaccaggaacatgattttaaattatgtgcctttactgcagctttcttgctctctttgtgtgtgtgcattctttccatttttttcttctttctggatgttaaatctgagtaatatatatcatttttaaagtggaattatgaccaggcatggtgcctcttgcctataatcctagcactttggcaagccaaggcaggaagattgcttgagcccaggagttcaacaccagcctgggcaacatggcaaaactccatctctacaaaaagtacaaaaatgagccaggtgttgtggggtgcgcctgtagtcccagctaaggaggctgagattgggaggatcacttgaacccaaaaggtggaggctgcagtgagctgagatcgtaccactacactccagcctgagtgacacagtgacagcctgtctcaaaaatataaaaataaataaataaataaagtggaatta

SEQ ID NO: 127761 - DNA, 626 bp, Homo sapiens
  Payload ID: 5007
  Gene Symbol: DNAJC24
  Gene Name: DnaJ (Hsp40) homolog, subfamily C, member 24
  ENST ID: ENST00000395949
  CDS Start-End: 1-89
aagatgatctaagaaatgtaggaccagtagatgctcaagtatatcttgaagaaatgtcttggaatgaagttacttctcagagacagtaaaatggaatgaccaatggatcagagattctttaagtcaaagggcacaagcatttcaacttcccaggaaaatgacacacttaaaatttccacgatcaggagcctaagtgatcactctttttatctgagttgcagatgtggtggaaaatacagtgtttccaaggatgaagcggaagaagttagcctgatttcttgtgatacatgttcactaattatagaactccttcattataactaaaattgttcacaacttgaaatgctttaactgtggtattgagacatgatgagaagccgttgagctttgtccattcaaggaaatggattatttgtcagcccgattatttgcaaagaaaatatacaattatcaagcagagaccacctcagattaatagagaatgaatataattatttatttgtatttataatttatatttacaagttgtcacaaaaatagatttgattatatttggtgaattcccatctgagaactttattatgtcatttttttccatgacacaaaataagaattttcttaatatg

SEQ ID NO: 127762 - DNA, 2004 bp, Homo sapiens
  Payload ID: 5007
  Gene Symbol: DNAJC24
  Gene Name: DnaJ (Hsp40) homolog, subfamily C, member 24
  ENST ID: ENST00000465995
  CDS Start-End: 107-556
ggaagaagaagccggtccggagttctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatgtatcatccagataaacaaagtacagatgtaccagcaggaacagtggaggaatgtgtacagaagttcatcgaaattgatcaagcatggaaaattctaggaaatgaagagacaaaaagagagtatgacctgcagcggtgtgaagatgatctaagaaatgtaggaccagtagatgctcaagtatatcttgaagaaatgtcttggaatgaaggtgatcactctttttatctgagttgcagatgtggtggaaaatacagtgtttccaaggatgaagcggaagaagttagcctgatttcttgtgatacatgttcactaattatagaactccttcattataactaaaattgttcacaacttgaaatgctttaactgtggtattgagacatgatgagaagccgttgagctttgtccattcaaggaaatggattatttgtcagcccgattatttgcaaagaaaatatacaattatcaagcagagaccacctcagattaatagagaatgaatataattatttatttgtatttataatttatatttacaagttgtcacaaaaatagatttgattatatttggtgaattcccatctgagaactttattatgtcatttttttccatgacacaaaataagaattttcttaatatgagcatgtctcctcttttcagtgggtaacagtatcatcatattcctttatagttactaagtttctggtctaaccgataacgtttctagttgctaaagttatggggctgttgtacacctagaatctttgtgaataatgtgaggccagttcttccataaggaaggctggttatggatattcataaggttatttcaaagttaataaagacaaagtggcaactgtagaaagtgttgcctccaatcttggtccgtatttccaaagcttgtaaacactgccatcttcaaatttaaatgtaatttaggaaatggaagcttttaattttaatttcttttttctaagacagagtctcactctgtcgcgccagctggagtgcagtgccatgatctcaggtcgctgtaacctccgtctcctgggttcaagtgattctccagcctcagcctcccgaatagctgggattacacgtgcccaccaccatgcccagctaatttttgtatttttagtagagatggggttccaccatgttggccaggctggtctcaaactcctgacctcaggtgatccacctgcctcgacctcccaaagtgctaggattacaggtttgagccaccgtgcctggcctaagttttgttaatagagatgggatttcatcatgttggctaggctggtcttgaactcctggcctcaaatgatccgcccacctcaacctcccaaagtgctgggattgcaggcgtgagccaccatgcctggccagaagcttttttaaaaataatgacttggaagttggtgcattatttccccttttattttggagtgttgatataatattggggccaggcatggtggctcacatctgtaatcccagcactttgggagactaaggcaggcggatcacctttggtcaggagttcaagaccaccctggccaacatggtgaaaccccatatctactaaaaataatttttttaaaaattagccagtcacgttggtgtctgcctgtggtcccagctactcgggaggctgaggcacaagaatcacttgaacccaggaggcagagtgagccgaggttgtgccactgcactgcagcctgggctacagagagcaagactctgtctcaaaaaaaataaaataaaataaataaaaaaagatata

SEQ ID NO: 127763 - DNA, 417 bp, Homo sapiens
  Payload ID: 5007
  Gene Symbol: DNAJC24
  Gene Name: DnaJ (Hsp40) homolog, subfamily C, member 24
  ENST ID: ENST00000525511
  CDS Start-End: 99-233
aagccggtccggagttctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatggatctattcctctatgtgatataaatgtcactgtgcttctgagttttatttgaccctcttcacttacaaggaaatcaaggattcttcatctgaggctcaggggactttggagtatcatccagataaacaaagtacagatgtaccagcaggaacagtggaggaatgtgtacagaagttcatcgaaattgatcaagcatggaaaattcta

SEQ ID NO: 127764 - DNA, 512 bp, Homo sapiens
  Payload ID: 5007
  Gene Symbol: DNAJC24
  Gene Name: DnaJ (Hsp40) homolog, subfamily C, member 24
  ENST ID: ENST00000527731
  CDS Start-End: 1-128
catctgcaaatatatcagacctaaaacaaaaatatcaaaaactcatattaatggttattggattttttccccctctttttggtgtacatacttggaaggacgcatctgtcacaggaaaatttttgtgaagcactcatcttctgacttgcccatgaattccttgttttaagcagtcaaggcaaacagtgtgcttctcaaattttagcacgcgtaacagttgcttggagagcttggtgaaacagagattctggagtcctccctctgaagatttgagtatcatccagataaacaaagtacagatgtaccagcaggaacagtggaggaatgtgtacagaagttcatcgaaattgatcaagcatggaaaattctaggaaatgaagagacaaaaagagagtatgacctgcagcggtgtgaagatgatctaagaaatgtaggaccagtagatgctcaagtatatcttgaagaaatgtcttggaatgaaggttggattttttttttctcttgacaacatt

SEQ ID NO: 127765 - DNA, 594 bp, Homo sapiens
  Payload ID: 5007
  Gene Symbol: DNAJC24
  Gene Name: DnaJ (Hsp40) homolog, subfamily C, member 24
  ENST ID: ENST00000526529
  CDS Start-End: 86-217
ctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatggcactagctggttgcttctattaaaatgttcagttgaagtgttaagagcaggtatccttgccttgttcctgattttaagaggaaaaccttcaatgttttaccagtggatggattacttgagtcttggagttggagaccagcctgggcaatatggaaacctcatctctacagaaaatacaaaaattagccaggttattggattttttccccctctttttggtgtacatacttggaaggacgcatctgtcacaggaaaatttttgtgaagcactcatcttctgacttgcccatgaattccttgttttaagcagtcaaggcaaacagtgtgcttctcaaattttagcacgcgtaacagttgcttggagagcttggtgaaacagagattctggagtcctccctct

SEQ ID NO: 127766 - DNA, 2192 bp, Homo sapiens
  Payload ID: 5007
  Gene Symbol: DNAJC24
  Gene Name: DnaJ (Hsp40) homolog, subfamily C, member 24
  ENST ID: ENST00000526042
  CDS Start-End: 90-347
cggagttctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatgtatcatccagataaacaaagtacagatgtaccagcaggaacagtggaggaatgtgtacagaagttcatcgaaattgatcaagcatggaaaattctaggaaatgaagagacaaaaagagagtatgacctgcagcggtgtggctcataaacctctctgatgagtcctgccagtgttttcttagatcccactgttgagacaatggagccacagaattctttcacctcttgttgtcagacaaatccaatagaacacaaggtcagaagggcctatacttctaaaggttgaaagattctttttcaaaagatgatctaagaaatgtaggaccagtagatgctcaagtatatcttgaagaaatgtcttggaatgaaggttggattttttttttctcttgacaacatttaaaaaaaaaaggaattttctataagaaaaaaaaactcattggatatttggaaatcttaaaaagaaataatagtgtggctttctatatatatgtggtaagtgtttctgtctggagtatttctgcttaattctaaactttatttattgactgatgtccccctatatgactcatttccagttatttttatattctaattagatgttaggaacataaagtttcataagagtttttttgttgtgtttttttactttagtttttgcattactgtctatgtagtattgtagtatggtaaataatgtcaaacaagatagttttttttttccgttccttttaatgttgacaagatgaattcctattagaatttttattttccctttatataaaatcataaactgtcaggacagggcttttaagaggcttgatttttttttttttttttttaacgctcacatactgattgtcttataagaagaaaagaatatctgccatttcccttgatgcaacatgaagtcatgtcttttttgcttttctgttattaaaattttagaacttaaattcaatgtcgtttccctattcttctgatggttccttgaattgttctggttagacatcattacattgggaaacacactttactaaacagaagccatgagtaccatacttacttgtttctctgggcaaatgaagaaaatcttactatttcctagaatctttatatatgcttaaccttttaaccttattgttcagcatgagtacaaattccctccaggtttataaaaatctactaatgagtgtggataggtagaagacaaaaacagagccatctgaaaccaaatttactttttaaatggcaaattcttaacttagtgcccctaagacgtgggtcacaagcctaacttagaaagggaatcatgtctttgcctctggggccattctgtccccaacccctcaagtgaaatcctagagtagaaattcagtgaataattggaaaagttgaggttttgtgtaactggggctcttggtggtgacagtctcatcagagtaaacacgaagaaatactgtgaaaacaatacactagtgatacagattttcactgctggtgtgtggaagggacactctagaatatgtcatttatcaggaagacttgcccagttaaaaaaaatatatgcacatatgtatatatacacacatatactttttattttttgccaaatacacaaacttcaaggagactaaatatgttttgaaaatatagtttgtctccttatctattggtatgtatatgtatgtttgtatgtgtttaatgtcttaataaattagttcttgctatagtcgatatgggtaatatattttgtttatgactgtgaaaatagtgaaaactggtttttataaatttttttttaccttttaaatatataacaatataatgttaagatcttaattttaaatgagaatacgggctggaagcctggaatcccagcactttgggaggctgagtttggagaatcgcagaggtcaggagtttgagaccagcctgggcaacataggaagactgtgagaacagattgtgagaataggaaaaaaaaaaaaaa

SEQ ID NO: 127767 - DNA, 4992 bp, Homo sapiens
  Payload ID: 5008
  Gene Symbol: DNAJC27
  Gene Name: DnaJ (Hsp40) homolog, subfamily C, member 27
  Uniprot ID: Q9NZQ0
  ENST ID: ENST00000264711
  CDS Start-End: 191-1012
gtctccctcccccggctccccacgctcccaaccgcccgcgcctgctgccaggcagcggcggggatggcgagcagcggaggcgaggcggtgacgagagcagcggctccgccattggacgaggaggcctgagggacgggccagcggtgcacaagaagagaccgaggcgggtggccccgagagagccagggccatggaggccaacatgccgaagcggaaggagcccggcaggtctctccgcatcaaagtcatctccatgggcaacgccgaagtggggaaaagctgtattataaagcgatactgtgagaaaagattcgtgtctaaatacctggcaacaattggaattgactatggagtcacaaaggtacacgtcagagacagagaaatcaaagttaacatctttgatatggctggacatcccttcttctatgaggttcgaaatgagttttacaaggacacacagggtgtgatactggtctatgatgttgggcagaaagactcctttgacgcccttgatgcgtggctggcagaaatgaagcaagagcttggacctcatggaaacatggaaaatattatatttgtagtttgtgccaacaagattgattgtaccaaacatcgctgtgtagatgaaagtgaaggacgtctttgggctgaaagcaaagggttcctgtactttgaaacttcagcacaaactggagaaggcattaatgagatgttccagaccttttatatatccatagttgatttatgtgaaaatggcgggaaacgccctaccaccaatagcagtgctagtttcaccaaagaacaagcagatgccattcgcagaattcgaaatagtaaagacagttgggacatgctgggagtcaaacctggggcctcaagggatgaagtcaataaagcgtatcggaaacttgctgtgcttcttcaccctgacaaatgtgtagcacctggcagtgaagatgccttcaaagcagttgtgaatgctcggacagccctcctgaaaaacatcaagtagaaagtacagaaaaaagccacatgtgggactcaaatgcaaacagactttccctagaggtgaaataaccaacgtggagttttccttcccagaatctcactgctcttttcattcatgtgttgtcatttgtatatcagtaattcaggtacccatttcatagacattttactgagaaatgacctgcatttgtatgaagtgaactgagcgtcacaccctgtacttcatttcatatttctagataattctgaatttttttctcattcgtcagctctgtaattatagtatcacttagacatttcacttggggaaatccacaaggttcctggaggagggaagagaggacaagaggaccctttcactttttcttttttacggaattcatcatcagagaagaaaataacaaaaatggaagcaaacaacatcagaacccctgtaagtttggtgtgaccttacagacaagttgctgcttttacaatgagttccttaggtggtattttaacccatcgatctataatgatgactcttggcagccctttgggagtttgtaaaatgaggtgatacagttctgaattgagcattcctttatgatattcactctgttcctcttctgcagccaccagtgggagagacaagccagtcctaagagaaaaggtggtggcagccacaaattctaggtacactggctgctgcctatcctgtccctggatctgaggcctttcccttgccatagaaatggttgctggtagcagtagagagcactgtgcacctgggaatgaggaatcaggccccaagacagaagtacttggaggagccagctgcagtagtatccgcctgtagtcccagctactcaggaggctgagacaggaggattgcttaagcccaggagctcaagtcccacctgggcaacatagtaagatcttgtctcttaaagaaaaaaaaaaaaggtacttagaggtcgcacttaaagattatgcacatcagcagaggaaaggccagccaagcttggggcaagcttgatgcagtaggagagactccttatgaggcttagcccttgtcttactgccagcctttgccacaggcaggtgagaaaggcagggccactcctcagcaaagttggcctcttctacacttcctcaccagtgttgtttcttccttttttcccctcttccccttcccgtcttgtgttttttctgaaccccacatctgccatcatttctctcctctagagtccctggcttctggccactgcctcctccctcttctaagccttggcctgaatctggttgatcagaggcaagtgtggatcctttgggtggcagtcaggggagatctcagggcctctgttgggaggaatctctgtaattcctgcttgggctccaaatttctgaagagtaatatttttaaactatagcttacaaaatacattctctgaccacagtctcctccttgatatacaagggatggatgaagttcatgtattaggactggcactccttacggtgcttatagaactagtctcaccacttgactcattacgtcgtcattcttgttacatcactcatacttttagctgcaaccacactaattcacatttttatatactttcaattagctgtactaattggggcttgaaagtatataaaatcttcctgtcctgtgaattttaaaaagctatcccatatcgattgccaaagagcatctaccttacctcctaagaagaaaagccactttcttccaatccaagcccactgcagccttgtggattttccacacagcagcttttcactgtatgcctgtacttgggctgcactgagcttgtcttcaggaaaccagagcgttgctttatcatcgcacttttcatcttggtaatatcaaaacaactttttaaatgaactgattgatatatgttatttcttgcgaggttttcctctggcctttaactggcttctgaggctacagaactccaacccagagttcttcgggacctaaattttgcttaaggaaggcctttatcatgctgaaagcactcagacatgtctgtcctcacagcagaatgtagaagtcatatgaatgagggatcgtgcacggtagcgtcagcccgaattgacacgacaactctgaatgtgtggccctctatgaaagctggtgccagttttcatcactgttattaaatactagattgggaacctcattcagccgtattgcacagatgagcaattacagcagagaaaattcattagtgctcccactcatatccttatgtgtgagttggtgaaatttagcctgagcttgattcttaggtcttgagactcagtttccaacaccttcattattaatgttaagaatggccatataccacttcatttacgtaaaaggaataaaataagcaagttaagcttcagggtcctagaatttttctgatttctataatccttcagcagaatattaagaaataaagcatgatctgcaatggaaaggtttttttggcactaacttcatgcagaatttcacagacatctatgcattaatttaaattcttggtgcaaatgtgtgctttgtagttcaaccttattaaaaattcttcagccagttaggatttcaaaatacattagtgagagtaacagctagcagaataattacaatggctaaaacgtttttatagagaatcttgtttttcaaaaaagaataaaaagtttgaatagctattattaaagaaaagccatgtcttcaacatctgagtcaccaagaagtaacactttttaaacttgttagaaatccctggaggcatttcaaattcatcttctaacctacctaagcactttaaaatacagcctccttctgttcctctgttccccttcatgcctccttttgaattgatatctcagctgtcaatatttctttgacttcagcattgttattttatttctctatatcaatgtgtccttagttttcttagcctgttaatttaaaaatccagacttgggggtcattgtgttgctacccaagagaaaatgctacagttttatagattgcacatcattctttaaggcatacttttacctcaggaaacttactctagtatgttctcatatattgaattctcaactaagtaactatttctttatacctataaactagtacctaattcactgttagttaaatgagctatagataaggcagctaaatttctgaaagatagccagagtaagtaagcagccactgcaagctctgaatcagttttttaaaaaaaagaaaaaaaaaaaaaaggagctgtgccccattgaacaatgacaacatcacaaggggaagggagggattttgccaaaagttagaaaggtggagctgtaagccatgtgcttgttgcctttgacagtgacagtgcgcgtcttacaactaattccactaggcatgggaatgtcacctcctttgccactgtaccccatcaagcttactctgaatcaaaggttttgtaaaacttttgaaaatgaacttagctgcaaaatatagctaaccactttccattgcaagctttgcaaagtgaagagaggttcgtacttctcataattggtatttagcacaattgtaagatacagttttactgtttgtacatcgtttttttccattaaacttttctagagaagacaaaagcttacactggtgacatggataagtgagatggtgtctaacgagcagtgcaatattaggcggtgcaatagaggccctgttggcaagatgagttttgctggagagctggacagtgttggttagcttcctgcattgattgcccctgggcgttcttcccccttaactgtgaaagcagagtctataaatgaactctttgctcttacaaggtaatttacatattttctttctgttgaaataactgaaaatgttaaatctaccagtttatgtcttgtaaacagagtgtcatatgtatttaagttgtgtatttttataaagtaaagccaagtatcaaacaccgg

SEQ ID NO: 127768 - DNA, 1378 bp, Homo sapiens
  Payload ID: 5008
  Gene Symbol: DNAJC27
  Gene Name: DnaJ (Hsp40) homolog, subfamily C, member 27
  Uniprot ID: Q9NZQ0
  ENST ID: ENST00000380809
  CDS Start-End: 159-431
cgcccgcgcctgctgccaggcagcggcggggatggcgagcagcggaggcgaggcggtgacgagagcagcggctccgccattggacgaggaggcctgagggacgggccagcggtgcacaagaagagaccgaggcgggtggccccgagagagccagggccatggaggccaacatgccgaagcggaaggagcccggcaggtctctccgcatcaaagtcatctccatgggcaacgccgaagtggggaaaagctgtattataaagcgatactgtgagaaaagattcgtgtctaaatacctggcaacaattggaattgactatggagtcacaaaggtacacgtcagagacagagaaatcaaagttaacatctttgatatggctggacatcccttcttctatgagatgaggaaactgagacgcagagaggttaagtgacttgcccaagatcacaaaactagttcgaaatgagttttacaaggacacacagggtgtgatactggtctatgatgttgggcagaaagactcctttgacgcccttgatgcgtggctggcagaaatgaagcaagagcttggacctcatggaaacatggaaaatattatatttgtagtttgtgccaacaagattgattgtaccaaacatcgctgtgtagatgaaagtgaaggacgtctttgggctgaaagcaaagggttcctgtactttgaaacttcagcacaaactggagaaggcattaatgagatgttccagatacatcttggatagaactaatggataaattagtctgtttaaaaaaaaaaagctaacaagaagagaataattacagtattctataaaccttttatatatccatagttgatttatgtgaaaatggcgggaaacgccctaccaccaatagcagtgctagtttcaccaaagaacaagcagatgccattcgcagaattcgaaatagtaaagacagttgggacatgctgggagtcaaacctggggcctcaagggatgaagtcaataaagcgtatcggaaacttgctgtgcttcttcaccctgacaaatgtgtagcacctggcagtgaagatgccttcaaagcagttgtgaatgctcggacagccctcctgaaaaacatcaagtagaaagtacagaaaaaagccacatgtgggactcaaatgcaaacagactttccctagaggtgaaataaccaacgtggagttttccttcccagaatctcactgctcttttcattcatgtgttgtcatttgtatatcagtaattcaggtacccatttcatagacattttactgagaaatgacctgcatttgtatgaagtgaactgagcgtcacaccctgtacttcatttcatatttctagataattctgaatttttttctca

SEQ ID NO: 127769 - DNA, 4831 bp, Homo sapiens
  Payload ID: 5008
  Gene Symbol: DNAJC27
  Gene Name: DnaJ (Hsp40) homolog, subfamily C, member 27
  Uniprot ID: Q9NZQ0
  ENST ID: ENST00000534855
  CDS Start-End: 191-724
gtctccctcccccggctccccacgctcccaaccgcccgcgcctgctgccaggcagcggcggggatggcgagcagcggaggcgaggcggtgacgagagcagcggctccgccattggacgaggaggcctgagggacgggccagcggtgcacaagaagagaccgaggcgggtggccccgagagagccagggccatggaggccaacatgccgaagcggaaggagcccggcaggtctctccgcatcaaagtcatctccatgggcaacgccgaagtggggaaaagctgtattataaagcgatactgtgagaaaagattcgtgtctaaatacctggcaacaattggaattgactatggagtcacaaaggtacacgtcagagacagagaaatcaaagttaacatctttgatatggctggacatcccttcttctatgaggttcgaaatgagttttacaaggacacacagggtgtgatactggtctatgatgttgggcagaaagactcctttgacgcccttgatgcgtggctggcagaaatgaagcaagagcttggacctcatggaaacatggaaaatattatatttgtagtttgtgccaacaagattgattgtaccaaacatcgctgtgtagatgaaagtgaaggacgtctttgggctgaaagcaaagggttcctgtactttgaaacttcagcacaaactggagaaggcattaatgagatgttccagggatgaagtcaataaagcgtatcggaaacttgctgtgcttcttcaccctgacaaatgtgtagcacctggcagtgaagatgccttcaaagcagttgtgaatgctcggacagccctcctgaaaaacatcaagtagaaagtacagaaaaaagccacatgtgggactcaaatgcaaacagactttccctagaggtgaaataaccaacgtggagttttccttcccagaatctcactgctcttttcattcatgtgttgtcatttgtatatcagtaattcaggtacccatttcatagacattttactgagaaatgacctgcatttgtatgaagtgaactgagcgtcacaccctgtacttcatttcatatttctagataattctgaatttttttctcattcgtcagctctgtaattatagtatcacttagacatttcacttggggaaatccacaaggttcctggaggagggaagagaggacaagaggaccctttcactttttcttttttacggaattcatcatcagagaagaaaataacaaaaatggaagcaaacaacatcagaacccctgtaagtttggtgtgaccttacagacaagttgctgcttttacaatgagttccttaggtggtattttaacccatcgatctataatgatgactcttggcagccctttgggagtttgtaaaatgaggtgatacagttctgaattgagcattcctttatgatattcactctgttcctcttctgcagccaccagtgggagagacaagccagtcctaagagaaaaggtggtggcagccacaaattctaggtacactggctgctgcctatcctgtccctggatctgaggcctttcccttgccatagaaatggttgctggtagcagtagagagcactgtgcacctgggaatgaggaatcaggccccaagacagaagtacttggaggagccagctgcagtagtatccgcctgtagtcccagctactcaggaggctgagacaggaggattgcttaagcccaggagctcaagtcccacctgggcaacatagtaagatcttgtctcttaaagaaaaaaaaaaaaggtacttagaggtcgcacttaaagattatgcacatcagcagaggaaaggccagccaagcttggggcaagcttgatgcagtaggagagactccttatgaggcttagcccttgtcttactgccagcctttgccacaggcaggtgagaaaggcagggccactcctcagcaaagttggcctcttctacacttcctcaccagtgttgtttcttccttttttcccctcttccccttcccgtcttgtgttttttctgaaccccacatctgccatcatttctctcctctagagtccctggcttctggccactgcctcctccctcttctaagccttggcctgaatctggttgatcagaggcaagtgtggatcctttgggtggcagtcaggggagatctcagggcctctgttgggaggaatctctgtaattcctgcttgggctccaaatttctgaagagtaatatttttaaactatagcttacaaaatacattctctgaccacagtctcctccttgatatacaagggatggatgaagttcatgtattaggactggcactccttacggtgcttatagaactagtctcaccacttgactcattacgtcgtcattcttgttacatcactcatacttttagctgcaaccacactaattcacatttttatatactttcaattagctgtactaattggggcttgaaagtatataaaatcttcctgtcctgtgaattttaaaaagctatcccatatcgattgccaaagagcatctaccttacctcctaagaagaaaagccactttcttccaatccaagcccactgcagccttgtggattttccacacagcagcttttcactgtatgcctgtacttgggctgcactgagcttgtcttcaggaaaccagagcgttgctttatcatcgcacttttcatcttggtaatatcaaaacaactttttaaatgaactgattgatatatgttatttcttgcgaggttttcctctggcctttaactggcttctgaggctacagaactccaacccagagttcttcgggacctaaattttgcttaaggaaggcctttatcatgctgaaagcactcagacatgtctgtcctcacagcagaatgtagaagtcatatgaatgagggatcgtgcacggtagcgtcagcccgaattgacacgacaactctgaatgtgtggccctctatgaaagctggtgccagttttcatcactgttattaaatactagattgggaacctcattcagccgtattgcacagatgagcaattacagcagagaaaattcattagtgctcccactcatatccttatgtgtgagttggtgaaatttagcctgagcttgattcttaggtcttgagactcagtttccaacaccttcattattaatgttaagaatggccatataccacttcatttacgtaaaaggaataaaataagcaagttaagcttcagggtcctagaatttttctgatttctataatccttcagcagaatattaagaaataaagcatgatctgcaatggaaaggtttttttggcactaacttcatgcagaatttcacagacatctatgcattaatttaaattcttggtgcaaatgtgtgctttgtagttcaaccttattaaaaattcttcagccagttaggatttcaaaatacattagtgagagtaacagctagcagaataattacaatggctaaaacgtttttatagagaatcttgtttttcaaaaaagaataaaaagtttgaatagctattattaaagaaaagccatgtcttcaacatctgagtcaccaagaagtaacactttttaaacttgttagaaatccctggaggcatttcaaattcatcttctaacctacctaagcactttaaaatacagcctccttctgttcctctgttccccttcatgcctccttttgaattgatatctcagctgtcaatatttctttgacttcagcattgttattttatttctctatatcaatgtgtccttagttttcttagcctgttaatttaaaaatccagacttgggggtcattgtgttgctacccaagagaaaatgctacagttttatagattgcacatcattctttaaggcatacttttacctcaggaaacttactctagtatgttctcatatattgaattctcaactaagtaactatttctttatacctataaactagtacctaattcactgttagttaaatgagctatagataaggcagctaaatttctgaaagatagccagagtaagtaagcagccactgcaagctctgaatcagttttttaaaaaaaagaaaaaaaaaaaaaaggagctgtgccccattgaacaatgacaacatcacaaggggaagggagggattttgccaaaagttagaaaggtggagctgtaagccatgtgcttgttgcctttgacagtgacagtgcgcgtcttacaactaattccactaggcatgggaatgtcacctcctttgccactgtaccccatcaagcttactctgaatcaaaggttttgtaaaacttttgaaaatgaacttagctgcaaaatatagctaaccactttccattgcaagctttgcaaagtgaagagaggttcgtacttctcataattggtatttagcacaattgtaagatacagttttactgtttgtacatcgtttttttccattaaacttttctagagaagacaaaagcttacactggtgacatggataagtgagatggtgtctaacgagcagtgcaatattaggcggtgcaatagaggccctgttggcaagatgagttttgctggagagctggacagtgttggttagcttcctgcattgattgcccctgggcgttcttcccccttaactgtgaaagcagagtctataaatgaactctttgctcttacaaggtaatttacatattttctttctgttgaaataactgaaaatgttaaatctaccagtttatgtcttgtaaacagagtgtcatatgtatttaagttgtgtatttttataaagtaaagccaagtatcaaacaccgg

SEQ ID NO: 127770 - DNA, 1625 bp, Homo sapiens
  Payload ID: 5009
  Gene Symbol: DNAJC28
  Gene Name: DnaJ (Hsp40) homolog, subfamily C, member 28
  Uniprot ID: Q9NX36
  ENST ID: ENST00000314399
  CDS Start-End: 440-1606
gcagaggcgcggcaggggggcgggagccgcggaacccctaccccaggtctgcgcaggtgaggagggggcggggcaggaccgacctcccttgccatgataaccaccttcgcagccggctcccagaccgttggcaccgattgcctagaaaatagggggtctcaggagctccgttttagcgtttatatatcccaattccaattaagccacttccagtattttttggccattgtcagtgtacaagtcttcctcctcttcgagaccatgttattgcaatagcagcaaacgtgttgggaggcctcacaattcatcatggtttttctggcctctggcagatagctccttcctagcgagctgtggagcttaaagtcttttggacacttgattctattcaatccagtatcagaccaggtcattgctaggaagaactctgggtacaataatgaatacaatgtatgtgatgatggctcagatcttaagatctcacctgataaaggctacagtgattcctaatcgagtgaaaatgcttccatattttggtatcattagaaatagaatgatgtcaacccataaatccaaaaagaagatcagagaatattatagactgctgaacgtggaggaaggatgctctgcagatgaagtcagggaatcttttcataagcttgccaagcaatatcatcctgacagtggctctaatactgctgattctgcaacatttataaggattgaaaaagcttatagaaaggtgctctcccatgtgatagaacaaacaaatgccagtcagagtaaaggtgaagaagaagaagatgtagaaaaattcaaatataaaacaccccaacaccgacattatttaagttttgaaggtattggttttgggactccaactcaacgagagaagcattataggcaatttagggcagaccgtgctgctgaacaagtgatggaatatcaaaagcagaaactacaaagccagtattttcctgatagtgtaattgttaaaaatataagacagagcaaacagcaaaagataacgcaagctatagaacgtttagtggaggacctcattcaagaatccatggcaaaaggagactttgacaatctcagtgggaaaggaaaacctctgaaaaagttttctgactgttcttacattgatcccatgactcacaacctgaaccgaatactgatcgataatggataccaaccagaatggatccttaagcaaaaggaaataagcgatactattgagcaactcagagaggcaattttagtgtctaggaaaaaacttgggaatccaatgacaccaactgaaaagaaacagtggaaccatgtttgtgagcagtttcaagaaaacatcagaaaattaaacaagcgaattaatgattttaatttaattgttcccatcctgaccaggcaaaaagtccattttgatgctcagaaagaaattgtcagagcccagaaaatatacgagacccttataaaaacaaaagaagtcacagatagaaacccaaataaccttgatcaaggagaaggagagaaaacacctgaaatcaagaaaggttttttaaactggatgaatctgtggaaatttattaaaatacgatcattttgatgtttactatcataaatca

SEQ ID NO: 127771 - DNA, 1354 bp, Homo sapiens
  Payload ID: 5009
  Gene Symbol: DNAJC28
  Gene Name: DnaJ (Hsp40) homolog, subfamily C, member 28
  Uniprot ID: Q9NX36
  ENST ID: ENST00000381947
  CDS Start-End: 151-1317
agctggtggtccccggtcgggacgaaggctcccgaggtgccctgcctgggtcctccggggtaaagttcgtttggcggaagattgtccgttttcctggtaaggtcacctgtcccaatcaggtcattgctaggaagaactctgggtacaataatgaatacaatgtatgtgatgatggctcagatcttaagatctcacctgataaaggctacagtgattcctaatcgagtgaaaatgcttccatattttggtatcattagaaatagaatgatgtcaacccataaatccaaaaagaagatcagagaatattatagactgctgaacgtggaggaaggatgctctgcagatgaagtcagggaatcttttcataagcttgccaagcaatatcatcctgacagtggctctaatactgctgattctgcaacatttataaggattgaaaaagcttatagaaaggtgctctcccatgtgatagaacaaacaaatgccagtcagagtaaaggtgaagaagaagaagatgtagaaaaattcaaatataaaacaccccaacaccgacattatttaagttttgaaggtattggttttgggactccaactcaacgagagaagcattataggcaatttagggcagaccgtgctgctgaacaagtgatggaatatcaaaagcagaaactacaaagccagtattttcctgatagtgtaattgttaaaaatataagacagagcaaacagcaaaagataacgcaagctatagaacgtttagtggaggacctcattcaagaatccatggcaaaaggagactttgacaatctcagtgggaaaggaaaacctctgaaaaagttttctgactgttcttacattgatcccatgactcacaacctgaaccgaatactgatcgataatggataccaaccagaatggatccttaagcaaaaggaaataagcgatactattgagcaactcagagaggcaattttagtgtctaggaaaaaacttgggaatccaatgacaccaactgaaaagaaacagtggaaccatgtttgtgagcagtttcaagaaaacatcagaaaattaaacaagcgaattaatgattttaatttaattgttcccatcctgaccaggcaaaaagtccattttgatgctcagaaagaaattgtcagagcccagaaaatatacgagacccttataaaaacaaaagaagtcacagatagaaacccaaataaccttgatcaaggagaaggagagaaaacacctgaaatcaagaaaggttttttaaactggatgaatctgtggaaatttattaaaatacgatcattttgatgtttactatcataaatcattcttagttccactgaca

SEQ ID NO: 127772 - DNA, 1480 bp, Homo sapiens
  Payload ID: 5009
  Gene Symbol: DNAJC28
  Gene Name: DnaJ (Hsp40) homolog, subfamily C, member 28
  Uniprot ID: Q9NX36
  ENST ID: ENST00000402202
  CDS Start-End: 306-1472
tcccgaggtgccctgcctgggtcctccggggtaaagttcgtttggcggaagattgtccgttttcctggtaaggtcacctgtcccaatcaggtacgattctgccttccgtacccccgagcccctcagtgtaaagtggcaaatggtctagcccggcggaggcaccagctggaggcggtgggagggacacccgcagtgaagggcggaccgcgcacgcatgcgcagaggcgcggcaggggggcgggagccgcggaacccctaccccaggtctgcgcaggtcattgctaggaagaactctgggtacaataatgaatacaatgtatgtgatgatggctcagatcttaagatctcacctgataaaggctacagtgattcctaatcgagtgaaaatgcttccatattttggtatcattagaaatagaatgatgtcaacccataaatccaaaaagaagatcagagaatattatagactgctgaacgtggaggaaggatgctctgcagatgaagtcagggaatcttttcataagcttgccaagcaatatcatcctgacagtggctctaatactgctgattctgcaacatttataaggattgaaaaagcttatagaaaggtgctctcccatgtgatagaacaaacaaatgccagtcagagtaaaggtgaagaagaagaagatgtagaaaaattcaaatataaaacaccccaacaccgacattatttaagttttgaaggtattggttttgggactccaactcaacgagagaagcattataggcaatttagggcagaccgtgctgctgaacaagtgatggaatatcaaaagcagaaactacaaagccagtattttcctgatagtgtaattgttaaaaatataagacagagcaaacagcaaaagataacgcaagctatagaacgtttagtggaggacctcattcaagaatccatggcaaaaggagactttgacaatctcagtgggaaaggaaaacctctgaaaaagttttctgactgttcttacattgatcccatgactcacaacctgaaccgaatactgatcgataatggataccaaccagaatggatccttaagcaaaaggaaataagcgatactattgagcaactcagagaggcaattttagtgtctaggaaaaaacttgggaatccaatgacaccaactgaaaagaaacagtggaaccatgtttgtgagcagtttcaagaaaacatcagaaaattaaacaagcgaattaatgattttaatttaattgttcccatcctgaccaggcaaaaagtccattttgatgctcagaaagaaattgtcagagcccagaaaatatacgagacccttataaaaacaaaagaagtcacagatagaaacccaaataaccttgatcaaggagaaggagagaaaacacctgaaatcaagaaaggttttttaaactggatgaatctgtggaaatttattaaaatacgatcattttgatgtttact

SEQ ID NO: 127773 - DNA, 1480 bp, Homo sapiens; identical to SEQ ID NO: 127772
  Payload ID: 5009
  Gene Symbol: DNAJC28
  Gene Name: DnaJ (Hsp40) homolog, subfamily C, member 28
  Uniprot ID: Q9NX36
  ENST ID: ENST00000573306
  CDS Start-End: 306-1472

SEQ ID NO: 127774 - DNA, 1625 bp, Homo sapiens; identical to SEQ ID NO: 127770
  Payload ID: 5009
  Gene Symbol: DNAJC28
  Gene Name: DnaJ (Hsp40) homolog, subfamily C, member 28
  Uniprot ID: Q9NX36
  ENST ID: ENST00000571432
  CDS Start-End: 440-1606

SEQ ID NO: 127775 - DNA, 1354 bp, Homo sapiens; identical to SEQ ID NO: 127771
  Payload ID: 5009
  Gene Symbol: DNAJC28
  Gene Name: DnaJ (Hsp40) homolog, subfamily C, member 28
  Uniprot ID: Q9NX36
  ENST ID: ENST00000572540
  CDS Start-End: 151-1317

SEQ ID NO: 127776 - DNA, 2237 bp, Homo sapiens
  Payload ID: 5009
  Gene Symbol: DNAJC28
  Gene Name: DnaJ (Hsp40) homolog, subfamily C, member 28
  Uniprot ID: Q9NX36
  ENST ID: ENST00000617313
  CDS Start-End: 440-1606
gcagaggcgcggcaggggggcgggagccgcggaacccctaccccaggtctgcgcaggtgaggagggggcggggcaggaccgacctcccttgccatgataaccaccttcgcagccggctcccagaccgttggcaccgattgcctagaaaatagggggtctcaggagctccgttttagcgtttatatatcccaattccaattaagccacttccagtattttttggccattgtcagtgtacaagtcttcctcctcttcgagaccatgttattgcaatagcagcaaacgtgttgggaggcctcacaattcatcatggtttttctggcctctggcagatagctccttcctagcgagctgtggagcttaaagtcttttggacacttgattctattcaatccagtatcagaccaggtcattgctaggaagaactctgggtacaataatgaatacaatgtatgtgatgatggctcagatcttaagatctcacctgataaaggctacagtgattcctaatcgagtgaaaatgcttccatattttggtatcattagaaatagaatgatgtcaacccataaatccaaaaagaagatcagagaatattatagactgctgaacgtggaggaaggatgctctgcagatgaagtcagggaatcttttcataagcttgccaagcaatatcatcctgacagtggctctaatactgctgattctgcaacatttataaggattgaaaaagcttatagaaaggtgctctcccatgtgatagaacaaacaaatgccagtcagagtaaaggtgaagaagaagaagatgtagaaaaattcaaatataaaacaccccaacaccgacattatttaagttttgaaggtattggttttgggactccaactcaacgagagaagcattataggcaatttagggcagaccgtgctgctgaacaagtgatggaatatcaaaagcagaaactacaaagccagtattttcctgatagtgtaattgttaaaaatataagacagagcaaacagcaaaagataacgcaagctatagaacgtttagtggaggacctcattcaagaatccatggcaaaaggagactttgacaatctcagtgggaaaggaaaacctctgaaaaagttttctgactgttcttacattgatcccatgactcacaacctgaaccgaatactgatcgataatggataccaaccagaatggatccttaagcaaaaggaaataagcgatactattgagcaactcagagaggcaattttagtgtctaggaaaaaacttgggaatccaatgacaccaactgaaaagaaacagtggaaccatgtttgtgagcagtttcaagaaaacatcagaaaattaaacaagcgaattaatgattttaatttaattgttcccatcctgaccaggcaaaaagtccattttgatgctcagaaagaaattgtcagagcccagaaaatatacgagacccttataaaaacaaaagaagtcacagatagaaacccaaataaccttgatcaaggagaaggagagaaaacacctgaaatcaagaaaggttttttaaactggatgaatctgtggaaatttattaaaatacgatcattttgatgtttactatcataaatcattcttagttccactgacactttacatggaaaatgagatttattgctataatacaagaatttaagaattgtgccattgtacttatcacaaaactaatcacatagccaatgatgtgtgagtgagaaacctatcaggtttgtcctgaggatatagcaagaaaagaaaataactgaaactcctttttttttgagacggcgtctcgctctgtcacccaggctggagtgcaatggcacaatctaggctcactgcaacctctgcttcccaggttcaagtgattatcctgcctcagactcccgaatagctgggattataggcacacaccaccatacccggctatttttgtattttgttttctttttttttgagacagagtctcactctgtcgcccaggctgggtgacagagcaagactccgtcttaaaaaaaaaaaaaaagtgggaattagacgtaagaggcttaactgcattacagcaacatagatgaacaaaaccattttccatattggtcaatgagaaggtaaggttaccagaaaatgtcagtaaatttttaatttcagcacagtgcactttatgtttgtaaatgttgtctatgttaataaagttactataataatt

SEQ ID NO: 127777 - DNA, 2237 bp, Homo sapiens; identical to SEQ ID NO: 127776
  Payload ID: 5009
  Gene Symbol: DNAJC28
  Gene Name: DnaJ (Hsp40) homolog, subfamily C, member 28
  Uniprot ID: Q9NX36
  ENST ID: ENST00000615701
  CDS Start-End: 440-1606

SEQ ID NO: 127778 - DNA, 2273 bp, Homo sapiens
  Payload ID: 5010
  Gene Symbol: DNAJC3
  Gene Name: DnaJ (Hsp40) homolog, subfamily C, member 3
  ENST ID: ENST00000376795
  CDS Start-End: 99-1460
cgagagccgacggcgggcgggcgcagctgctgccggagcgccggcgcgtgctggtgggccacacacctttcctcctcttcactcgcgagccctcggacatggtggcccccggctccgtgaccagccggctgggctcggtattccccttcctgctagtcctggtggatctgcagtacgaaggtgctgaatgtggagtaaatgcagatgttgagaaacatcttgaattgggcaagaaattacttgcagctggacagctagctgatgctttatctcagtttcatgctgccgtagatggtgaccctgataactatattgcttattatcggagggctactgtctttttagctatgggcaaatcaaaagctgcacttcctgatttaactaaagtgattcaattgaagatggacttcactgcagcaagattacagagaggtcacttattactcaaacaaggaaaacttgatgaagcagaagatgattttaaaaaagtggtttgtgtttgggatgcagaactacgggaacttcgagctgaatgttttataaaagaaggagaacctaggaaagctataagtgacttaaaagctgcgtcaaagttgaagaatgataatactgaagcgttttataaaataagcacactgtactaccaactaggagaccacgaactgtccctcagtgaagttcgggaatgtcttaaacttgaccaggatcataaaaggtgttttgcacactataaacaagtaaagaaacttaataagctgattgagtcagctgaagagctcatcagagatggcagatacacagatgctaccagcaaatatgaatctgtcatgaaaacagagccaagcattgctgaatatacagttcgttcaaaggagaggatttgccactgcttttctaaggacgagaagcctgttgaagctattagggtttgttctgaagttttacagatggaacctgacaatgtgaatgccctgaaagatcgagcagaggcctatttgatagaggaaatgtatgatgaagctattcaggattatgaaactgctcaggaacacaatgaaaatgatcagcagattcgagaaggtctagagaaagcacaaagattattgaaacagtcgcagaaacgagattattataaaatcttgggagtaaaaagaaatgccaaaaagcaagaaattattaaagcataccgaaaattagcactgcagtggcacccagataacttccagaatgaagaagaaaagaaaaaagctgagaaaaagttcattgatatagcagctgctaaagaagtcctctctgatccagaaatgagaaagaagtttgacgacggagaagatcctttggatgcagagagccagcaaggaggcggcggcaaccctttccacagaagctggaactcatggcaagggttcaatcccttcagctcaggcggaccatttagatttaaattccacttcaattaaaccaactgtttttctgctcttcttaatttttttaaagattaaaaacaaagaaatcttgttccgggaccctaatgaaaaaaaatttcaaatcttttcagtttgtccatgaccaaagagttgctttaataggaaaaaatctgttcttatccctgtcagatttatggttaatgggtttgcaacggcaaggaggcaaggaatggttctatttctgacagagcagcctgcatctgctttatgctgtctggagggaagtggtctgaggcaggctcacccgtggaagtgctcacgtattctgtattatttttctacactggagctgagattcttctcttcacagccttgcagagtaagtcagtgcctacaagtgtaagaaggagctgtaatcttcatgaggatggttatacttcagtattcttaaagagaacatgaacatttttgagctgtatgttcttagggacaactgtgcttcgatgtggtcagtctcgtcacttgtgagtagctgtgaaatctttagtgtgcatgtgtttgcacctctgtggtctgtcaacgtggctgtcactgaaggagcaagagaccatcttttaggaaccctgccaccaaataataatatatccaggcttagactttggattaatgttaaatgtacatttttttggttcagtacctgaagaagaatactgaaacttgaatctataaattcctatggacccttttaatattaaacacaacaaattaaaagttgttataggtaaaataagttcagataaaatagtggtggtatttaaaataatattgctgaagtgcagattgaaa

SEQ ID NO: 127779 - DNA, 5591 bp, Homo sapiens
  Payload ID: 5010
  Gene Symbol: DNAJC3
  Gene Name: DnaJ (Hsp40) homolog, subfamily C, member 3
  Uniprot ID: Q13217
  ENST ID: ENST00000602402
  CDS Start-End: 118-1632
agagccactgaggcctgagcgagagccgacggcgggcgggcgcagctgctgccggagcgccggcgcgtgctggtgggccacacacctttcctcctcttcactcgcgagccctcggacatggtggcccccggctccgtgaccagccggctgggctcggtattccccttcctgctagtcctggtggatctgcagtacgaaggtgctgaatgtggagtaaatgcagatgttgagaaacatcttgaattgggcaagaaattacttgcagctggacagctagctgatgctttatctcagtttcatgctgccgtagatggtgaccctgataactatattgcttattatcggagggctactgtctttttagctatgggcaaatcaaaagctgcacttcctgatttaactaaagtgattcaattgaagatggacttcactgcagcaagattacagagaggtcacttattactcaaacaaggaaaacttgatgaagcagaagatgattttaaaaaagtgctcaaatctaatccaagtgaaaatgaagaaaaggaagcacagtctcaacttataaaatctgatgaaatgcagcgtttgcgttcacaagcacttaacgcttttggaagtggagattatactgctgctatagccttccttgataagattttagaggtttgtgtttgggatgcagaactacgggaacttcgagctgaatgttttataaaagaaggagaacctaggaaagctataagtgacttaaaagctgcgtcaaagttgaagaatgataatactgaagcgttttataaaataagcacactgtactaccaactaggagaccacgaactgtccctcagtgaagttcgggaatgtcttaaacttgaccaggatcataaaaggtgttttgcacactataaacaagtaaagaaacttaataagctgattgagtcagctgaagagctcatcagagatggcagatacacagatgctaccagcaaatatgaatctgtcatgaaaacagagccaagcattgctgaatatacagttcgttcaaaggagaggatttgccactgcttttctaaggacgagaagcctgttgaagctattagggtttgttctgaagttttacagatggaacctgacaatgtgaatgccctgaaagatcgagcagaggcctatttgatagaggaaatgtatgatgaagctattcaggattatgaaactgctcaggaacacaatgaaaatgatcagcagattcgagaaggtctagagaaagcacaaagattattgaaacagtcgcagaaacgagattattataaaatcttgggagtaaaaagaaatgccaaaaagcaagaaattattaaagcataccgaaaattagcactgcagtggcacccagataacttccagaatgaagaagaaaagaaaaaagctgagaaaaagttcattgatatagcagctgctaaagaagtcctctctgatccagaaatgagaaagaagtttgacgacggagaagatcctttggatgcagagagccagcaaggaggcggcggcaaccctttccacagaagctggaactcatggcaagggttcaatcccttcagctcaggcggaccatttagatttaaattccacttcaattaaaccaactgtttttctgctcttcttaatttttttaaagattaaaaacaaagaaatcttgttccgggaccctaatgaaaaaaaatttcaaatcttttcagtttgtccatgaccaaagagttgctttaataggaaaaaatctgttcttatccctgtcagatttatggttaatgggtttgcaacggcaaggaggcaaggaatggttctatttctgacagagcagcctgcatctgctttatgctgtctggagggaagtggtctgaggcaggctcacccgtggaagtgctcacgtattctgtattatttttctacactggagctgagattcttctcttcacagccttgcagagtaagtcagtgcctacaagtgtaagaaggagctgtaatcttcatgaggatggttatacttcagtattcttaaagagaacatgaacatttttgagctgtatgttcttagggacaactgtgcttcgatgtggtcagtctcgtcacttgtgagtagctgtgaaatctttagtgtgcatgtgtttgcacctctgtggtctgtcaacgtggctgtcactgaaggagcaagagaccatcttttaggaaccctgccaccaaataataatatatccaggcttagactttggattaatgttaaatgtacatttttttggttcagtacctgaagaagaatactgaaacttgaatctataaattcctatggacccttttaatattaaacacaacaaattaaaagttgttataggtaaaataagttcagataaaatagtggtggtatttaaaataatattgctgaagtgcagattgaaatactttttaaacaactgaagttctgagtttttatagggaatttcatgtaacaagactggtttagaaacgtaaagttgcgcagtcaacataaataaatacagaatgccatgttctccacttctaagtaaagacagtgggcagcttctgtttctccttctatcaaggcttcaccctatcttaaaggtctgtggtgcctcccacgtgggacctgtctgctggtatgtgttaaacagcagaccggcccttctaccagatcttgatgcctctgattttctcctgcctacaagaaaatacaggcaaggttagtcaggtctggctatatttccactgttgtttcatttaataagatggcatctcctcttgagatatgttcttcttaccttttaagaagatactatttaagaagtgaactattcagtctttgtatactgaatgctttttccctaaaaaatgttaatcaagaatattgaatatttatggcactcttgatgctgcatttgaaagctgaaggaattactttagatagataggaattgctacctttattctggaaaggttttgtttctgcctcaaagcattttgaagtgttttaaccattaaagggtctaatttttttttcttaatgaaatcaagcattttaattcactgtgggaggcatcctgaccacggacatccataacagcaaagcacaaatcgttttcgtctgtagtcatatcctgaaacataggtggacaaatttttaactgagagacaaaaatcacatagttgaattgagcagaacacttaagtgctttctgcatctatttaggagtctatttcttaccaataaacttgacaacgcatttggaaaactagtgaacaccttacagctttcattttgctttaatgtttcaattcaagccggtgtaaaaataatttccaaggcatttctgtttattctttagtaatctcactactggctatgtcagcaatatctttttcaatctggttccttttgtatatgatgtcactgtgacctctttgaaatatagtgatggcttttacctactttgaaaagaattttcacatagagtcagaaaaaaaaggaaatatcaaatcacttgcctttccacttggagagcacgacagttgccaacaacaaggggtcaagggccgcacaggagatgtgtgggggcctggccacctcccacctgctgcccagaggcttgtttgcattttcattttttctccacttgtaacaaccatagtttcagctcctaaattcttatcatggatttacttagtcatcttaactgacctgcagttacttgcctgttttcagtgaagagagagaagcagctctggtgccacatgccagtgccatggagggaaatgaattctctgcaatctgttgtttcgctgattcatgaagaaagtaacaactgttgagtttcagccttgatggctgtcggcagttttctggtgtccacccaaacggagagacagtcactcctgcttaccctaatgtgtgactgagaagcagcctgggtgtgtaaagagatagtcattccccctgcctgtctcactgtagggtagcattatccactgtaaaaccatactactttcattttcccttggggactacaggtgccaggtaacctttttttttttttttttttttttttgagacagaatcttgctctgttgcccaggctggagtgcagggacacctcccgggttcaagcagttctcctgcctcagcctccaagtagctgggactataggcacgcaccaccatgcctggctaatttttgtatttttagtagaaatggggtttcactgtgttagccaggatggtcttgatctcctgaccttgtgatctgcccgccttggccttccaaagtgttgggattacaggcgtgagccactgcgcctggccatcaggtaacctttatggctctttcaggaaaagtgaaatcagagaggcgtaccctagccacagctgttgtattctgctcttctttcctttttggtgagcttcatgggtggagttatcagtggtctgtactttgtggatattttgcccagcaggaagtattagacacatcagtctagaagcattgtgaaaaggttccaaaacgggagacaaaatttaattcattcctcagttctgaaagtttgtgctttcttaccatgaatagatgaaaacttgaaaaaaatcttgacagtttactaatgtgaatcagatgtaacgtactactaattctacaatgcctttctctttagtcagtattaaaaatcttttttaaagtattggtatgaaaacaaatttttgttgccctgataatggaattttaaaactacccacagtttaagagaaaacataacttggtaaaaaaggtagccaataaaaccacaatttgaaattgataccattttctactcacaatggatgatgaaaaatttcacctttaaatgggtcagaagttgtctttgacatttaccatgaaaaaactacataaaatggctccctggtgaggttacagacacggccctggtgatgggcgttgcaaagttttcactgagcacacagcaatggtatcacctagagaagttcacgcaactttgttgaatgtagttgacttttccaaatttataaaggaaggaagaaggcaaatgttaatttgccaacaacgaatatcctttttctaaatcagatcattccttttttgttagtggcagtttatcctgtaatttcaaatgacgttaagaggtgggattatttgggggttttttttgtttgtttacagatgatctcatttgctgaatgattgatttaagagtaaaattagccactgcgtggctttgtgtatagtaaccggttttgttgcacttgtctgtggctgaaacacttacctgcagtggaaagccgagcaaggaggaggtaaacattggagatgtttgtgaaaatattactcttgctgtgaggttttagtttgttttgaatgagaaaagactaagtaacttaatccatctcaatgtagtgttttaataaaaaaggaacctaatatttgaaatgggtctcagacatgtctacaaatatgggtactatttttatgcccgtgtattttcacatttaataaaaatatttatggtcatatcagtat

SEQ ID NO: 127780 - DNA, 2485 bp, Homo sapiens
  Payload ID: 5011
  Gene Symbol: DNAJC30
  Gene Name: DnaJ (Hsp40) homolog, subfamily C, member 30
  Uniprot ID: Q96LL9
  ENST ID: ENST00000395176
  CDS Start-End: 31-711
ctcttgcaccgcctgccgaatcaattcaacatggcagccatgcgctggcgatggtggcagcggctgttaccttggaggttgctgcaggcccgtggctttccacaaaattctgcacccagcctgggcctaggagcgaggacttattcccagggcgactgctcgtattcgcgcacggcgctgtatgatctgctcggcgtcccctccacagccacgcaggcccaaatcaaggcggcttactaccgtcagtgctttctctaccacccggaccgcaactccgggagcgcggaggccgccgagcgcttcacgcgcatctcccaggcctacgtggtgctgggcagtgccaccctccgtcgcaagtatgatcgcggcctactcagcgacgaggacctgcgcggacctggcgtccggccctccaggacgcccgcacccgaccccggctcgccgcgtaccccgccgcccacctctcggacccacgacggttctcgggcctcccccggcgccaaccgcacgatgttcaactttgacgccttctaccaggcccactacggggaacaactggagcgggaacggcgcctgagggcccggcgggaggcccttcgcaaacggcaggagtatcggtccatgaaaggcctccgctgggaggatacccgagacacggctgccattttcctcatcttttcaatcttcatcatcatcggcttttatatttaatcggagagagaagggaaggggagtgtccccagccaaccccccagaaacggccttttttcctgcctctgaacccttggccattgatagtctacctttgctgggatccgaaggaactgtactccccctgccctccccgacccgcccagcttagccgatgacctgcacatcgctccactgtggtccagaaaaggaggcctttcgatgtctgagaaagaggccccacgctgtagagtcccgaaagcccaggagtgaagggggttcctggagtctctagggtgcttcttccagagtctgtcttcttgcttccagatgtggtcaacttctggaacactcgctgtagctttattgtttagccccaagcaagatttatctcctcctgccccgcatgtgtatggtgggcctctgtaaccttgaaatgtgcaatgtgaccaattgttgactaccaaaagaaaaggtctggggttgtacgaaacttgtctttctgtgacttccccaagccgcaggtgagacctggtccagggtaagaatgggatcggtggagagcctgtcgttcctcccgctaaggtcagccccctggggcactcctccttatgttgatagcatgtaggagtgagaaaaagtcattgagcataaggaatgagtgttcctgtgcccatatttaatgtgtgaccttggagaagttactctgtaggcatgacagcagaggagaaaatcatttggcatcttgaggtctgtcatgctttattatccatagtttttggggggttttttgttttgttttgtttttgagatggagtcttgcgctctgttgcccaggctggagtgcagtggtgcgatcttagctcactgcaacctccacctcccgggttcaagcgattctcctgcctcagcctcctgtgtaactgggattacaggctcccaccacacctggctagtgttttgtatttttagtagatacggggtttcaccatgctggccagactgaggtctcgaactgccgacctcaggctgtctgcccgtccagcctcccaaagtgctgggattgcaggcatgagccactgctcccggccctattatccatagttctaatccacagggattacagcataatgctagcagggccaggttcatccttgagacagtgtggctggctgtcacctggtcctccctttaccagccagccccattgcacactgtgcagcccatcccctcccagaaatagagtgacaaactctgcacttaagtcccctgtttctgtttaacttgcagtgcttatcacaggcccttccttaattttttaaacaaggctgcttgaggctggggtaaattttggggctttgggagtacacaggactactgagggacggggagttggtggcttggtgttcatggtggagacttggttctttacgcagagcaggctaaaggcgtgttttttctgctctgtttctaattcatgttaagtagttggtcatcactttggtcagagctgctgctgaagctctcttaactgtgagtcactggacgttggcagggagttggctgtgagattgtaggtgctcaagtgtttctgttcgggactgagtgtgaatctgtaaaaggggaaaatcctcgcaagaggtctacgagaaggatgagggcccaagtctagggtctaaacaaagccaggagtggtttggtatattactgagtgcaatcattgcgtgccattcctgcactcaatgtattgtgtaaaatccttaggtaaaatgggataaacccacagctggtccta

SEQ ID NO: 127781 - DNA, 1015 bp, Homo sapiens
  Payload ID: 5012
  Gene Symbol: DNAJC4
  Gene Name: DnaJ (Hsp40) homolog, subfamily C, member 4
  ENST ID: ENST00000321460
  CDS Start-End: 98-847
aggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagcagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggaaggtgaagcagatgcaccttaacttcatggatgaaaaggatcggatcatcacagccttctacaacgaagcccgggcacgggccaggtctgtccctgctctattctgctccctgctccctgtccaggaaccacacttcgggatccctatcccaaccacccaggtgccctctcctccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 127782 - DNA, 759 bp, Homo sapiens
  Payload ID: 5012
  Gene Symbol: DNAJC4
  Gene Name: DnaJ (Hsp40) homolog, subfamily C, member 4
  ENST ID: ENST00000355040
  CDS Start-End: 289-492
aagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagaggaaggtgaagcagatgcaccttaacttcatggatgaaaaggatcggatcatcacagccttctacaacgaagcccgggcacgggccaggtctgtccctgctctattctgctccctgctccctgtccaggaaccacacttcgggatccctatcccaaccacccaggtgccctctcctccagggccaacagaggcatccttcagcaggagcgacaacggctagggcagcggcagccgccaccatccgagccaacccaaggccccgagatcgtgccccggggcgccggcccctga

SEQ ID NO: 127783 - DNA, 1288 bp, Homo sapiens
  Payload ID: 5012
  Gene Symbol: DNAJC4
  Gene Name: DnaJ (Hsp40) homolog, subfamily C, member 4
  Uniprot ID: Q9NNZ3
  ENST ID: ENST00000321685
  CDS Start-End: 466-1191
acaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggaaggtgaagcagatgcaccttaacttcatggatgaaaaggatcggatcatcacagccttctacaacgaagcccgggcacgggccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 127784 - DNA, 502 bp, Homo sapiens
  Payload ID: 5012
  Gene Symbol: DNAJC4
  Gene Name: DnaJ (Hsp40) homolog, subfamily C, member 4
  ENST ID: ENST00000535246
  CDS Start-End: 1-502
tgaactgttgggggtgcatcctggtgccagcactgaggaagttaaacgagctttcttctccaagtccaaagagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggaaggtgaagcagatgcaccttaacttcatggatgaaaaggatcggatcatcacagccttctacaacgaagcccgggcacgggccagggccaacagaggcatccttcagcaggagcgacaacggctagggcagcggcagccgccaccatccgagccaaccca

SEQ ID NO: 127785 - DNA, 693 bp, Homo sapiens
  Payload ID: 5012
  Gene Symbol: DNAJC4
  Gene Name: DnaJ (Hsp40) homolog, subfamily C, member 4
  ENST ID: ENST00000536006
  CDS Start-End: 204-347
ccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggaggctcccaggtttgtctcaggtaaccctcgccttccctgctgaggatcagagatagagaagacccccaaggtcatacaccgatttaagcggcagaggaggaagtttgagtccaggtccagacccagtacttattatgaactgttgggggtgcatcctggtgccagcactgaggaagttaaacgagctttcttctccaagtccaaagagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagctcctggac

SEQ ID NO: 127786 - DNA, 938 bp, Homo sapiens
  Payload ID: 5012
  Gene Symbol: DNAJC4
  Gene Name: DnaJ (Hsp40) homolog, subfamily C, member 4
  ENST ID: ENST00000628077
  CDS Start-End: 466-669
acaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagaggaaggtgaagcagatgcaccttaacttcatggatgaaaaggatcggatcatcacagccttctacaacgaagcccgggcacgggccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgc

SEQ ID NO: 127787 - DNA, 5213 bp, Homo sapiens
  Payload ID: 5013
  Gene Symbol: DNAJC5
  Gene Name: DnaJ (Hsp40) homolog, subfamily C, member 5
  Uniprot ID: Q9H3Z4
  ENST ID: ENST00000360864
  CDS Start-End: 154-750
acccgcgccctctgccgccgccgccgccgccgcccggggtctccaggctgaggagtgcgtcggccgctgcccagcagcgccgcgaatcggggagcggagccgcggagccggcgggagggcgggcgggcgggcggacgggcagaatagcctaacatggcagaccagagacagcgctcactgtctacctctggggagtcattgtaccacgtccttgggttggacaagaacgcaacctcagatgacattaaaaagtcctatcggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagagggaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggcagcttccgcgcctccctgtccacgtgctaacagatcaggacgcccccagcacccctgcctgcttttgctggtggcagtgacgggaccccgactcctcactctcgggccgcagacaatgctgtgagcaagtgtggccatgggcacagaatgtccctttggacgccgctgctgggggctgccaggggccctctggggtcgtgctttgaggcccgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggccctggagcctcacgccgtcgaggctgctctcaggcgttctgttccgggcgaggcttgtgctgcaaggaagggcaccagcatgcaggctgccactggagggtccgggtgctgcgggcagagttcagcgcttgtccaccctcccttagctctgactcagtgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggcccccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcagatacggtcagtggcaaagctgcatctgaagggcggcctgggaaggggccctgtgctggccccgggtccgccccagaggagtccacacagcaccacctccagaaggggctgggcccggggtcctgcaggcggcaccttttggtagagtttgtttccctggaaaatggggaaaatgtttcaagccaggtgaggggggaagttaacactgaaatatgtattgtttttaaaaatcaaatgcacacgcatggaagctgcttgtccatgcactggttttgtcactggcgtcctggaatccgaccgtgttggggtgcaggcgctgtcagactccggctgatcctggctcgagcacacacatctaagggccaggctggttccgcatggtgatctccgtcttgtatgtctgaatgttggcctaaaataaagattactgttgtaaaataaatgttttcactgcggacccca

SEQ ID NO: 127788 - DNA, 5287 bp, Homo sapiens
  Payload ID: 5013
  Gene Symbol: DNAJC5
  Gene Name: DnaJ (Hsp40) homolog, subfamily C, member 5
  Uniprot ID: Q9H3Z4
  ENST ID: ENST00000470551
  CDS Start-End: 154-657
acccgcgccctctgccgccgccgccgccgccgcccggggtctccaggctgaggagtgcgtcggccgctgcccagcagcgccgcgaatcggggagcggagccgcggagccggcgggagggcgggcgggcgggcggacgggcagaatagcctaacatggcagaccagagacagcgctcactgtctacctctggggagtcattgtaccacgtccttgggttggacaagaacgcaacctcagatgacattaaaaagtcctatcggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagaggggagggcactgacactgtgccgcgagtgtttgtggtggcagctgggactgttgaggtgtgaacgtggaccctgagaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggcagcttccgcgcctccctgtccacgtgctaacagatcaggacgcccccagcacccctgcctgcttttgctggtggcagtgacgggaccccgactcctcactctcgggccgcagacaatgctgtgagcaagtgtggccatgggcacagaatgtccctttggacgccgctgctgggggctgccaggggccctctggggtcgtgctttgaggcccgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggccctggagcctcacgccgtcgaggctgctctcaggcgttctgttccgggcgaggcttgtgctgcaaggaagggcaccagcatgcaggctgccactggagggtccgggtgctgcgggcagagttcagcgcttgtccaccctcccttagctctgactcagtgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggcccccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcagatacggtcagtggcaaagctgcatctgaagggcggcctgggaaggggccctgtgctggccccgggtccgccccagaggagtccacacagcaccacctccagaaggggctgggcccggggtcctgcaggcggcaccttttggtagagtttgtttccctggaaaatggggaaaatgtttcaagccaggtgaggggggaagttaacactgaaatatgtattgtttttaaaaatcaaatgcacacgcatggaagctgcttgtccatgcactggttttgtcactggcgtcctggaatccgaccgtgttggggtgcaggcgctgtcagactccggctgatcctggctcgagcacacacatctaagggccaggctggttccgcatggtgatctccgtcttgtatgtctgaatgttggcctaaaataaagattactgttgtaaaataaatgttttcactgcggacccca

SEQ ID NO: 127789 - DNA, 1382 bp, Homo sapiens
  Payload ID: 5014
  Gene Symbol: DNAJC5B
  Gene Name: DnaJ (Hsp40) homolog, subfamily C, member 5 beta
  Uniprot ID: Q9UF47
  ENST ID: ENST00000276570
  CDS Start-End: 288-887
gcagttactgatatagccaaggtgggacactactggagggagctagaagggatcagccagccatgcctccagttcaggtacttggcattgctaagctcagaacaggacttgccagtgtctagatgaaaaagaggagagatctcaagagggataaccaattggctggcaaagtaacaaatgaaaagtaacctgactctattgacctgcttaaccctgcatgggggggaaggatggaaaggagcagctgtttgctttgaaacggtggaacagttttgcagccttagaaaatggcatgtaacatacctaaccaaagacagcggactctgtcaacaacaggagaagctctatacgaaattcttggtctgcataagggagcatcaaatgaagaaattaagaaaacctacagaaaattggccctgaaacaccatccagacaagaatccagatgatccagctgctactgagaagtttaaagaaatcaacaacgcccacgcaatacttaccgacatttcaaagagaagcatatacgacaagtacggatcgctgggactctacgtggccgagcagtttggagacgaaaacgttaacacctacttcatgctgtcgagctggtgggcaaaggccctgtttgtcatcgttggcctcttgacgggctgctacttttgctgctgcctgtgctgctgctgcaactgctgctgtggacactgccggcccgagtcatcagtgccagaagaggacttctatgtgtccccagaggatctggaggagcagatcaagtctgacatggaaaaagatgtggactttccagtttttctccagcctacaaatgcaaatgagaaaacacagctaatcaaagaaggatctcgaagttattgcacagactcttgatattgagccctcagagagtccacagtccctcctctcagttcagtcttgtctccagatggtcgtaggggagcgtgtggggcataaagtgctgtgaacttttccatcttgttgttttatttttgggttaggaaaacatgattgctatataattttctcagtatgcagactttctctctgagtagaatttcttatgaaacacattcaatttgggtgaataaaggcctgaagagttattttaccctccttgcctgatgtaggacagtggaattgtacagcctttatgaacctgccctttatgtgtggcagatctgattcctaactgaccaaagtaatattccagaacaaaagccacttttcttacatttaacacaatattcatatctaccacgaacatgatcatcaaaatatatgagaacttataaagagtttttgtgtgtggagcctcttccgtgtcaatattcaataaagttatagaaatgtttcaagagccagaaa

SEQ ID NO: 127790 - DNA, 441 bp, Homo sapiens
  Payload ID: 5014
  Gene Symbol: DNAJC5B
  Gene Name: DnaJ (Hsp40) homolog, subfamily C, member 5 beta
  ENST ID: ENST00000522619
  CDS Start-End: 153-441
gtgttttccagagggataaccaattggctggcaaagtaacaaatgaaaagtaacctgactctattgacctgcttaaccctgcatgggggggaaggatggaaaggagcagctgtttgctttgaaacggtggaacagttttgcagccttagaaaatggcatgtaacatacctaaccaaagacagcggactctgtcaacaacaggagaagctctatacgaaattcttggtctgcataagggagcatcaaatgaagaaattaagaaaacctacagaaaattggccctgaaacaccatccagacaagaatccagatgatccagctgctactgagaagtttaaagaaatcaacaacgcccacgcaatacttaccgacatttcaaagagaagcatatacgacaagtacggatcgctgggactctacgtggccgagcagtttggagacg

SEQ ID NO: 127791 - DNA, 2008 bp, Homo sapiens
  Payload ID: 5015
  Gene Symbol: DNAJC5G
  Gene Name: DnaJ (Hsp40) homolog, subfamily C, member 5 gamma
  Uniprot ID: Q8N7S2
  ENST ID: ENST00000296097
  CDS Start-End: 419-988
aaaaaacgacctgcccagaccctcagcgtcgacgctgcgcacaagcgcagtcaactgctggacccggccggtgtgaagtttcacacccaaaaggatgaagggcacccacctggcttaagagaacgactcccagaaaattagccgggcgtggtggcgtgcacctgtaatctcagctactcgggaggctgaggcaggaaaatcgcttgcacccaggaggtggaggttgcagtgagccgagatcgcgccattacacttcagcctgggcaacaagagcaaaaaactccgtcaaaaaaaaaaaaaagaagaagaagttgtggagctgtctgattcctgatcctgtccgttcaggctggggccgccctggtctttcaaacccagcagtgagcttggacagacccagaggtgtttactccagatcatgtctactgtgaaggaagcagcacaccggctgtccaaaagtgagatgagcctctatgcagtgctggatcttaagaagggcgcctcacctgaagacttcaaaaaatcctacagccattccgcattgcttccccaccctccttttgagtatcacctgggtaggaaactggccttgcggtatcatcccgacaagaatccagggaatgctcaagcagcagaaatattcaaagagatcaacgcagctcatgccatactgagcgactctaagaagcggaaaatttacgaccagcatggctcattgggaatatatctgtatgatcactttggtgaagaaggcgtcagatactattttattctgaatagttgttggttcaagacacttgtcatcctgtgtactctgctcacttgttgctgtttctgttgttgctgctgtttttgctgtggagcacttaaaccaccacctgagcaggatagtgggagaaaatatcagcagaatgtccagagtcagcctccaaggtcaggagccaaatgtgattttagaagcgaggaaaatagcgaagatgatttttaagagatgaagaaggatgaggtgctgacccagtgagggtgccttctgctgcccagtcccctggacacattgaagagaggagcaagtagccctgtcctgacattgaccctgatttgacccctcttcttataaggatctcaagaatctcttcagaagcactgatgacgttgatcccagtaaggacatcacctctacccttggtaccacaactctgtatggggttgcccagctactcttcctttcagttgcagtcccaattttactccgtcagaaagcagccctcccctccctccccttatgaggtctcaggcagtggtggcagatttttcctgaagagtctttttcctgtgtctgccttgttattggaaccaatgccagctggtaggatccctgagccccttgcgatatcaccaccaagagcctgataactgagcagggtggatcctgtccctggagctgctgcacccattaattctcccttgttgcaactctgtgtaccaagaacccctagcatcagcctcattcctaagccaataacgcctgtatggagttggtttcatcttctggtgcccacggccattggcattgccagcctcattccatgccactatgagtcaactcaggaaaactgcgagtgcatttgaggcttaggggtagtcattccatctttagattatccttggacttcagctaccagcacagcatgcattagccttggtcctgtaggttaactgaagttcaaacatcagtgccagcttgcctccatccttttcacatattatgcaggccaattgacatataatttgttcttaaaaataggggcatgaaatatgtgatctggaaaagattgtactttctggactcttttcccactcttgcctctttgtgctgctgtttcgtatcctcctcacaccgtgtatttcccacccactcagggtcacagcctactaattcctcaaacttctctccctggactaggagaaaggctaaagaatgtcagtaaataaaagagctttcatccaa

SEQ ID NO: 127792 - DNA, 1904 bp, Homo sapiens
  Payload ID: 5015
  Gene Symbol: DNAJC5G
  Gene Name: DnaJ (Hsp40) homolog, subfamily C, member 5 gamma
  Uniprot ID: Q8N7S2
  ENST ID: ENST00000402462
  CDS Start-End: 315-884
aagcgcagtcaactgctggacccggccggtgtgaagtttcacacccaaaaggatgaagggcacccacctggcttaagagaacgactcccaggtaaagggccagacccaggaggtggaggttgcagtgagccgagatcgcgccattacacttcagcctgggcaacaagagcaaaaaactccgtcaaaaaaaaaaaaaagaagaagaagttgtggagctgtctgattcctgatcctgtccgttcaggctggggccgccctggtctttcaaacccagcagtgagcttggacagacccagaggtgtttactccagatcatgtctactgtgaaggaagcagcacaccggctgtccaaaagtgagatgagcctctatgcagtgctggatcttaagaagggcgcctcacctgaagacttcaaaaaatcctacagccattccgcattgcttccccaccctccttttgagtatcacctgggtaggaaactggccttgcggtatcatcccgacaagaatccagggaatgctcaagcagcagaaatattcaaagagatcaacgcagctcatgccatactgagcgactctaagaagcggaaaatttacgaccagcatggctcattgggaatatatctgtatgatcactttggtgaagaaggcgtcagatactattttattctgaatagttgttggttcaagacacttgtcatcctgtgtactctgctcacttgttgctgtttctgttgttgctgctgtttttgctgtggagcacttaaaccaccacctgagcaggatagtgggagaaaatatcagcagaatgtccagagtcagcctccaaggtcaggagccaaatgtgattttagaagcgaggaaaatagcgaagatgatttttaagagatgaagaaggatgaggtgctgacccagtgagggtgccttctgctgcccagtcccctggacacattgaagagaggagcaagtagccctgtcctgacattgaccctgatttgacccctcttcttataaggatctcaagaatctcttcagaagcactgatgacgttgatcccagtaaggacatcacctctacccttggtaccacaactctgtatggggttgcccagctactcttcctttcagttgcagtcccaattttactccgtcagaaagcagccctcccctccctccccttatgaggtctcaggcagtggtggcagatttttcctgaagagtctttttcctgtgtctgccttgttattggaaccaatgccagctggtaggatccctgagccccttgcgatatcaccaccaagagcctgataactgagcagggtggatcctgtccctggagctgctgcacccattaattctcccttgttgcaactctgtgtaccaagaacccctagcatcagcctcattcctaagccaataacgcctgtatggagttggtttcatcttctggtgcccacggccattggcattgccagcctcattccatgccactatgagtcaactcaggaaaactgcgagtgcatttgaggcttaggggtagtcattccatctttagattatccttggacttcagctaccagcacagcatgcattagccttggtcctgtaggttaactgaagttcaaacatcagtgccagcttgcctccatccttttcacatattatgcaggccaattgacatataatttgttcttaaaaataggggcatgaaatatgtgatctggaaaagattgtactttctggactcttttcccactcttgcctctttgtgctgctgtttcgtatcctcctcacaccgtgtatttcccacccactcagggtcacagcctactaattcctcaaacttctctccctggactaggagaaaggctaaagaatgtcagtaaataaaagagctttcatccaa

SEQ ID NO: 127793 - DNA, 1562 bp, Homo sapiens
  Payload ID: 5015
  Gene Symbol: DNAJC5G
  Gene Name: DnaJ (Hsp40) homolog, subfamily C, member 5 gamma
  Uniprot ID: Q8N7S2
  ENST ID: ENST00000406962
  CDS Start-End: 166-480
ctgctggacccggccggtgtgaagtttcacacccaaaaggatgaagggcacccacctggcttaagagaacgactcccagtgagtttcctgtcactggaagtgcacttctcggtacccttacttgtagaagttctcacagatgctgcttctcctctggctcagatcatgtctactgtgaaggaagcagcacaccggctgtccaaaagtgagatgagcctctatgcagtgctggatcttaagaagggcgcctcacctgaagacttcaaaaaatcctacagacacttgtcatcctgtgtactctgctcacttgttgctgtttctgttgttgctgctgtttttgctgtggagcacttaaaccaccacctgagcaggatagtgggagaaaatatcagcagaatgtccagagtcagcctccaaggtcaggagccaaatgtgattttagaagcgaggaaaatagcgaagatgatttttaagagatgaagaaggatgaggtgctgacccagtgagggtgccttctgctgcccagtcccctggacacattgaagagaggagcaagtagccctgtcctgacattgaccctgatttgacccctcttcttataaggatctcaagaatctcttcagaagcactgatgacgttgatcccagtaaggacatcacctctacccttggtaccacaactctgtatggggttgcccagctactcttcctttcagttgcagtcccaattttactccgtcagaaagcagccctcccctccctccccttatgaggtctcaggcagtggtggcagatttttcctgaagagtctttttcctgtgtctgccttgttattggaaccaatgccagctggtaggatccctgagccccttgcgatatcaccaccaagagcctgataactgagcagggtggatcctgtccctggagctgctgcacccattaattctcccttgttgcaactctgtgtaccaagaacccctagcatcagcctcattcctaagccaataacgcctgtatggagttggtttcatcttctggtgcccacggccattggcattgccagcctcattccatgccactatgagtcaactcaggaaaactgcgagtgcatttgaggcttaggggtagtcattccatctttagattatccttggacttcagctaccagcacagcatgcattagccttggtcctgtaggttaactgaagttcaaacatcagtgccagcttgcctccatccttttcacatattatgcaggccaattgacatataatttgttcttaaaaataggggcatgaaatatgtgatctggaaaagattgtactttctggactcttttcccactcttgcctctttgtgctgctgtttcgtatcctcctcacaccgtgtatttcccacccactcagggtcacagcctactaattcctcaaacttctctccctggactaggagaaaggctaaagaatgtcagtaaataaaagagctttcatccaatcccaaggcatatattatgcccaaaaaagacaaattgtgtctggggtagagaaaaaaggcctaaagaaa

SEQ ID NO: 127794 - DNA, 1647 bp, Homo sapiens
  Payload ID: 5015
  Gene Symbol: DNAJC5G
  Gene Name: DnaJ (Hsp40) homolog, subfamily C, member 5 gamma
  ENST ID: ENST00000404433
  CDS Start-End: 106-627
ctgctggacccggccggtgtgaagtttcacacccaaaaggatgaagggcacccacctggcttaagagaacgactcccagatgctgcttctcctctggctcagatcatgtctactgtgaaggaagcagcacaccggctgtccaaaagtgagatgagcctctatgcagtgctggatcttaagaagggcgcctcacctgaagacttcaaaaaatcctacaggaaactggccttgcggtatcatcccgacaagaatccagggaatgctcaagcagcagaaatattcaaagagatcaacgcagctcatgccatactgagcgactctaagaagcggaaaatttacgaccagcatggctcattgggaatatatctgtatgatcactttggtgaagaaggcgtcagatactattttattctgaatagttgttggttcaagacacttgtcatcctgtgtactctgctcacttgttgctgtttctgttgttgctgctgtttttgctgtggagcacttaaaccaccacctgagcaggatagtgggagaaaatatcagcagaatgtccagagtcagcctccaaggtcaggagccaaatgtgattttagaagcgaggaaaatagcgaagatgatttttaagagatgaagaaggatgaggtgctgacccagtgagggtgccttctgctgcccagtcccctggacacattgaagagaggagcaagtagccctgtcctgacattgaccctgatttgacccctcttcttataaggatctcaagaatctcttcagaagcactgatgacgttgatcccagtaaggacatcacctctacccttggtaccacaactctgtatggggttgcccagctactcttcctttcagttgcagtcccaattttactccgtcagaaagcagccctcccctccctccccttatgaggtctcaggcagtggtggcagatttttcctgaagagtctttttcctgtgtctgccttgttattggaaccaatgccagctggtaggatccctgagccccttgcgatatcaccaccaagagcctgataactgagcagggtggatcctgtccctggagctgctgcacccattaattctcccttgttgcaactctgtgtaccaagaacccctagcatcagcctcattcctaagccaataacgcctgtatggagttggtttcatcttctggtgcccacggccattggcattgccagcctcattccatgccactatgagtcaactcaggaaaactgcgagtgcatttgaggcttaggggtagtcattccatctttagattatccttggacttcagctaccagcacagcatgcattagccttggtcctgtaggttaactgaagttcaaacatcagtgccagcttgcctccatccttttcacatattatgcaggccaattgacatataatttgttcttaaaaataggggcatgaaatatgtgatctggaaaagattgtactttctggactcttttcccactcttgcctctttgtgctgctgtttcgtatcctcctcacaccgtgtatttcccacccactcagggtcacagcctactaattcctcaaacttctctccctggactaggagaaaggctaaagaatgtcagtaaataaaagagctttcatccaa

SEQ ID NO: 127795 - DNA, 593 bp, Homo sapiens
  Payload ID: 5015
  Gene Symbol: DNAJC5G
  Gene Name: DnaJ (Hsp40) homolog, subfamily C, member 5 gamma
  ENST ID: ENST00000420191
  CDS Start-End: 407-593
gcccagaccctcagcgtcgacgctgcgcacaagcgcagtcaactgctggacccggccggtgtgaagtttcacacccaaaaggatgaagggcacccacctggcttaagagaacgactcccagaaaattagccgggcgtggtggcgtgcacctgtaatctcagctactcgggaggctgaggcaggaaaatcgcttgcacccaggaggtggaggttgcagtgagccgagatcgcgccattacacttcagcctgggcaacaagagcaaaaaactccgtcaaaaaaaaaaaaaagaagaagaagttgtggagctgtctgattcctgatcctgtccgttcaggctggggccgccctggtctttcaaacccagcagtgagcttggacagacccagaggtgtttactccagatcatgtctactgtgaaggaagcagcacaccggctgtccaaaagtgagatgagcctctatgcagtgctggatcttaagaagggcgcctcacctgaagacttcaaaaaatcctacagacacttgtcatcctgtgtactctgctcacttgttgctgtttctgttgttgctgctgtttttgctgtggagcact

SEQ ID NO: 127796 - DNA, 5916 bp, Homo sapiens
  Payload ID: 5016
  Gene Symbol: DNAJC6
  Gene Name: DnaJ (Hsp40) homolog, subfamily C, member 6
  Uniprot ID: O75061
  ENST ID: ENST00000263441
  CDS Start-End: 370-3072
gtgtttacgtctgccttcatccccatcctttccgctccagcataagcaaaattataaccccgcacaccgacttgcatgcaattatcatagcccgagtgctcctccgttgagagacttcgcccccgagaccgctgactgtgaatgacaaatcaaaagtcagggttgcagaatcagccggactttcctgctcatttgcagcagagggaggaagcagagaatgaaagattctgaaaataaaggagtggttattattgagtcgagaatttttgggaaaagtaacacgtggagagtcaatttttgagtggaaggagtctgaagagagggtaggaaccaacctcctactacccaccaggtgcctcatctccagacatggagcccagctatgggggaggtctctttgacatggtaaaaggaggtgcagggaggctctttagtaacctaaaggacaacttgaaagacaccctcaaagacacatcttctagagtgatacaatctgtgaccagctacacaaagggagatttagacttcacttatgttacctccagaattattgtgatgtcctttcctctggacaatgttgacataggattcaggaatcaggttgatgacattcgaagctttttggattccagacatcttgaccactacacagtatacaatctgtcacctaagtcttatcgaactgccaagtttcacagccgggtctcagaatgcagttggcccattaggcaggctcccagtctgcacaacctttttgctgtgtgtcggaatatgtataactggctactgcagaatcccaaaaatgtctgtgttgtccactgcttggatggacgggcggcatcatcaattctggttggtgctatgttcattttctgtaatctctactctactcctggcccagccattcgattgctatatgcaaagcgaccaggaattggactttcaccatcccataggagatacctgggctatatgtgtgacctactggcagacaagccctaccgccctcacttcaagcctctcacaattaagtcgatcactgtcagtccaataccctttttcaacaaacagaggaatggatgtcgcccttactgtgatgtactcattggagaaaccaaaatatattcgacttgcacagattttgaacgaatgaaagaatatcgtgtccaagatggaaaaatcttcattcccttgaacatcactgtgcaaggagacgtggttgtttccatgtatcacttgaggtcaaccattgggagccggctacaggctaaggtgaccaacacacagatattccagcttcagtttcacactggattcataccactggacacaacagttttaaagttcaccaagcctgagttagatgcatgtgatgtaccagaaaaatatcctcagctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggacaggctccaatagatatccctccagacaaccccaggcattacggacaaagtggtttctttgcctctctctgttggcaagatcagaaatcggagaagtcattctgtgaggaggaccacgctgccctagtgaatcaggaaagtgagcaatcagatgatgaacttctgacactttccagtccgcatggcaatgccaatggtgacaagcctcatggagtcaagaagcccagcaaaaagcagcaggagccagcagcccctccaccccctgaggatgtggaccttttgggcctggaagggtctgcaatgagtaacagcttctctccgccagcggctcctcccaccaattctgaactactgagtgacctgtttgggggtggaggtgcagctggtcccacccaggctggacagtcaggagtggaagatgtgtttcatcctagtggacctgcgtctacccagtcaacaccacgccgctctgccacctccacctctgcgtctccaaccctaagagtgggagaaggtgccacctttgacccatttggagcaccttctaaaccatcaggtcaggatttgctgggttcttttctgaacacatccagtgcttccagtgacccctttctccagccaacaagaagtccttcgcccacagtacatgcttctagtacgcctgctgtgaacattcagccagatgtttctggaggttgggactggcatgctaaaccaggaggctttggaatgggaagcaagtcagctgccaccagcccaaccggatcctcgcatggtactcccacccatcaaagcaaaccccagactctggatccttttgccgaccttgggacactaggtagttcttcctttgccagcaaacccaccacaccaactggattgggtggaggattcccgcctctcagctcgccacagaaggcgtctccccagcctatgggtggcgggtggcagcagggaggtgcctacaactggcagcagccacagcctaagcctcagcccagcatgccccactcctctccccagaaccgacccaactacaacgtgagcttctcagccatgcctgggggccagaacgaacgtgggaaaggatcaagtaatttggaagggaaacaaaaagcagctgattttgaagacctactctctggtcaaggtttcaatgctcacaaagacaaaaaggggcctcggacaatagctgagatgagaaaggaggaaatggccaaggaaatggatcctgagaaattaaagattctggaatggattgaaggcaaagaaagaaatatcagagcccttctttccacgatgcataccgtactatgggctggggagaccaagtggaaaccagttggcatggcagacctggtaacaccagagcaggtgaagaaggtgtacaggaaggctgtcctggtggtgcacccagataaagctactgggcaaccctatgaacaatacgcaaagatgattttcatggagctcaatgatgcctggtctgaatttgaaaaccaaggccaaaagcccttatattaatttatgagcttttccatctctgctgcagacctgtgctaatgcttagtgtgtgtcacaattctgaggttttcgcagatgaaccaaaaactccagtaacatgttttcagtactaaaccgttaagttactcatgaattaatttctcattgataaggaatgtggatgtttggtttctccaaagttcccaccataaaagatccaaagcatgagaggaacttctagtcagatgaccttgcagaaccaccgcattccaccctgccctttggggagcctactcagcattctacctggggaaatggaaaacagaggccaccacccatgaaggcataacacccatcacattgtctgagaataggattaatgagcaaaagttatgataatagagttatatgatggtttaatggtttctagatttttcttggaaagatataatttgagcagtggctttatgcagactccaagaacaaaaccaccaggtatttttttttaagtaaaaatttactaaggcctttagcataatactgtaaatgtcttttggtcaagagaactaacaaatataaaggaacttgaaatgtggggagtgataatagtccagtgattaaactacagtccagtgattaccaccaactttctgactaagctaaaaatgaatgaaaatggtggctaaagaaaatagggactctgaagatgtcgaaatctttattcctggttaggaaggtgggccgctacccttctttccctttagaaaactgtgattaattaaataaaaagtcttactactataacaactctaaacctggtttaaatgaaacatctaattttgctgtaaggcttaatgctcttcttttgtttagccaagaaaacattcttagttggaaacaggtggtaaagtagtttggcctgttcacaacttatcaggaccaatatctagtgtggactcagtgttctctaggtttgtgagcagttgtggtaagagaatggaaggcaacactgaataggagttaagggaatggcacgatcacagtgagagagctgcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagaccaacaggtctttgcattccttttaaataactggttgtgacaaagcttgttgttgatcagattcactgtttcatcatatttattgtaatatattttttgttttgtaaatatgttacaacaaaatgtgattggtctaaaatatttgtaatgtatattaaaaggttcaaaaatatttgtataaatctaagttatttgggtacttgtaggaatacaatgaggagcttgaatgccaccttctgacatgatttacttttaaggaaagttatgaggagagaatacaaaaagcatgcaccaaaatgtaatctgacaggatttctggatttatacgtaatcactcctgccccaacacacacacacacacacacacacacacacacacacatgcacgcacacatgattttgattatgctacatgatatatgtttcaaaaagaattagcatagaaatcctggtctcctagccaaaaaaatcaaaggattttcaaaaaaacgaatctgtatgttgaggcaaaaggattgaacctggaagtctgggactttatcatagaaacaaagtctcagatattttagttctttggaaacaaatgctgtaattcaaaagcatttgacctgtcactgtactatctacatgtggaagaatgttcaagttgaatcctaatgccgtgaatgaaacacagtctgtgtagggaatgagcaaaaaagttgaattccaattgctttttggccttttggctaaaataaatgtagcatctaattttatcagttt

SEQ ID NO: 127797 - DNA, 5365 bp, Homo sapiens
  Payload ID: 5016
  Gene Symbol: DNAJC6
  Gene Name: DnaJ (Hsp40) homolog, subfamily C, member 6
  Uniprot ID: O75061
  ENST ID: ENST00000371069
  CDS Start-End: 202-3114
gccgagctcagcccagggcggcggcttcgcctcgcccggcgaagcttctctccggtggccgctccttcttttccctcctctttgcgtcatgtcgggcacttaatttttttttttttttaattccttcttcagccctttccaccttccatctcccttttcgcttcccaggttgattattttctcttttctccgggcttgcccatgagcctcctcgggagctaccggaaaaagaccagcaacgatggttatgaatctttgcagctggtggacagtaacggggacttaagtgcgggaagcggcggggttggcggcaagcagagagtgaacgccggggcagcggcgcggagtcccgcccgacagcctccggaccgcgccagcaccatggacagctcaggtgcctcatctccagacatggagcccagctatgggggaggtctctttgacatggtaaaaggaggtgcagggaggctctttagtaacctaaaggacaacttgaaagacaccctcaaagacacatcttctagagtgatacaatctgtgaccagctacacaaagggagatttagacttcacttatgttacctccagaattattgtgatgtcctttcctctggacaatgttgacataggattcaggaatcaggttgatgacattcgaagctttttggattccagacatcttgaccactacacagtatacaatctgtcacctaagtcttatcgaactgccaagtttcacagccgggtctcagaatgcagttggcccattaggcaggctcccagtctgcacaacctttttgctgtgtgtcggaatatgtataactggctactgcagaatcccaaaaatgtctgtgttgtccactgcttggatggacgggcggcatcatcaattctggttggtgctatgttcattttctgtaatctctactctactcctggcccagccattcgattgctatatgcaaagcgaccaggaattggactttcaccatcccataggagatacctgggctatatgtgtgacctactggcagacaagccctaccgccctcacttcaagcctctcacaattaagtcgatcactgtcagtccaataccctttttcaacaaacagaggaatggatgtcgcccttactgtgatgtactcattggagaaaccaaaatatattcgacttgcacagattttgaacgaatgaaagaatatcgtgtccaagatggaaaaatcttcattcccttgaacatcactgtgcaaggagacgtggttgtttccatgtatcacttgaggtcaaccattgggagccggctacaggctaaggtgaccaacacacagatattccagcttcagtttcacactggattcataccactggacacaacagttttaaagttcaccaagcctgagttagatgcatgtgatgtaccagaaaaatatcctcagctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggacaggctccaatagatatccctccagacaaccccaggcattacggacaaagtggtttctttgcctctctctgttggcaagatcagaaatcggagaagtcattctgtgaggaggaccacgctgccctagtgaatcaggaaagtgagcaatcagatgatgaacttctgacactttccagtccgcatggcaatgccaatggtgacaagcctcatggagtcaagaagcccagcaaaaagcagcaggagccagcagcccctccaccccctgaggatgtggaccttttgggcctggaagggtctgcaatgagtaacagcttctctccgccagcggctcctcccaccaattctgaactactgagtgacctgtttgggggtggaggtgcagctggtcccacccaggctggacagtcaggagtggaagatgtgtttcatcctagtggacctgcgtctacccagtcaacaccacgccgctctgccacctccacctctgcgtctccaaccctaagagtgggagaaggtgccacctttgacccatttggagcaccttctaaaccatcaggtcaggatttgctgggttcttttctgaacacatccagtgcttccagtgacccctttctccagccaacaagaagtccttcgcccacagtacatgcttctagtacgcctgctgtgaacattcagccagatgtttctggaggttgggactggcatgctaaaccaggaggctttggaatgggaagcaagtcagctgccaccagcccaaccggatcctcgcatggtactcccacccatcaaagcaaaccccagactctggatccttttgccgaccttgggacactaggtagttcttcctttgccagcaaacccaccacaccaactggattgggtggaggattcccgcctctcagctcgccacagaaggcgtctccccagcctatgggtggcgggtggcagcagggaggtgcctacaactggcagcagccacagcctaagcctcagcccagcatgccccactcctctccccagaaccgacccaactacaacgtgagcttctcagccatgcctgggggccagaacgaacgtgggaaaggatcaagtaatttggaagggaaacaaaaagcagctgattttgaagacctactctctggtcaaggtttcaatgctcacaaagacaaaaaggggcctcggacaatagctgagatgagaaaggaggaaatggccaaggaaatggatcctgagaaattaaagattctggaatggattgaaggcaaagaaagaaatatcagagcccttctttccacgatgcataccgtactatgggctggggagaccaagtggaaaccagttggcatggcagacctggtaacaccagagcaggtgaagaaggtgtacaggaaggctgtcctggtggtgcacccagataaagctactgggcaaccctatgaacaatacgcaaagatgattttcatggagctcaatgatgcctggtctgaatttgaaaaccaaggccaaaagcccttatattaatttatgagcttttccatctctgctgcagacctgtgctaatgcttagtgtgtgtcacaattctgaggttttcgcagatgaaccaaaaactccagtaacatgttttcagtactaaaccgttaagttactcatgaattaatttctcattgataaggaatgtggatgtttggtttctccaaagttcccaccataaaagatccaaagcatgagaggaacttctagtcagatgaccttgcagaaccaccgcattccaccctgccctttggggagcctactcagcattctacctggggaaatggaaaacagaggccaccacccatgaaggcataacacccatcacattgtctgagaataggattaatgagcaaaagttatgataatagagttatatgatggtttaatggtttctagatttttcttggaaagatataatttgagcagtggctttatgcagactccaagaacaaaaccaccaggtatttttttttaagtaaaaatttactaaggcctttagcataatactgtaaatgtcttttggtcaagagaactaacaaatataaaggaacttgaaatgtggggagtgataatagtccagtgattaaactacagtccagtgattaccaccaactttctgactaagctaaaaatgaatgaaaatggtggctaaagaaaatagggactctgaagatgtcgaaatctttattcctggttaggaaggtgggccgctacccttctttccctttagaaaactgtgattaattaaataaaaagtcttactactataacaactctaaacctggtttaaatgaaacatctaattttgctgtaaggcttaatgctcttcttttgtttagccaagaaaacattcttagttggaaacaggtggtaaagtagtttggcctgttcacaacttatcaggaccaatatctagtgtggactcagtgttctctaggtttgtgagcagttgtggtaagagaatggaaggcaacactgaataggagttaagggaatggcacgatcacagtgagagagctgcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagaccaacaggtctttgcattccttttaaataactggttgtgacaaagcttgttgttgatcagattcactgtttcatcatatttattgtaatatattttttgttttgtaaatatgttacaacaaaatgtgattggtctaaaatatttgtaatgtatattaaaaggttcaaaaata

SEQ ID NO: 127798 - DNA, 5743 bp, Homo sapiens
  Payload ID: 5016
  Gene Symbol: DNAJC6
  Gene Name: DnaJ (Hsp40) homolog, subfamily C, member 6
  Uniprot ID: O75061
  ENST ID: ENST00000395325
  CDS Start-End: 158-2899
cgcacaccgacttgcatgcaattatcatagcccgagtgctcctccgttgagagacttcgcccccgagaccgctgactgtgaatgacaaatcaaaagtcagggttgcagaatcagccggactttcctgctcatttgcagcagagggaggaagcagagaatgaaagattctgaaaataaaggtgcctcatctccagacatggagcccagctatgggggaggtctctttgacatggtaaaaggaggtgcagggaggctctttagtaacctaaaggacaacttgaaagacaccctcaaagacacatcttctagagtgatacaatctgtgaccagctacacaaagggagatttagacttcacttatgttacctccagaattattgtgatgtcctttcctctggacaatgttgacataggattcaggaatcaggttgatgacattcgaagctttttggattccagacatcttgaccactacacagtatacaatctgtcacctaagtcttatcgaactgccaagtttcacagccgggtctcagaatgcagttggcccattaggcaggctcccagtctgcacaacctttttgctgtgtgtcggaatatgtataactggctactgcagaatcccaaaaatgtctgtgttgtccactgcttggatggacgggcggcatcatcaattctggttggtgctatgttcattttctgtaatctctactctactcctggcccagccattcgattgctatatgcaaagcgaccaggaattggactttcaccatcccataggagatacctgggctatatgtgtgacctactggcagacaagccctaccgccctcacttcaagcctctcacaattaagtcgatcactgtcagtccaataccctttttcaacaaacagaggaatggatgtcgcccttactgtgatgtactcattggagaaaccaaaatatattcgacttgcacagattttgaacgaatgaaagaatatcgtgtccaagatggaaaaatcttcattcccttgaacatcactgtgcaaggagacgtggttgtttccatgtatcacttgaggtcaaccattgggagccggctacaggctaaggtgaccaacacacagatattccagcttcagtttcacactggattcataccactggacacaacagttttaaagttcaccaagcctgagttagatgcatgtgatgtaccagaaaaatatcctcagctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggacaggctccaatagatatccctccagacaaccccaggcattacggacaaagtggtttctttgcctctctctgttggcaagatcagaaatcggagaagtcattctgtgaggaggaccacgctgccctagtgaatcaggaaagtgagcaatcagatgatgaacttctgacactttccagtccgcatggcaatgccaatggtgacaagcctcatggagtcaagaagcccagcaaaaagcagcaggagccagcagcccctccaccccctgaggatgtggaccttttgggcctggaagggtctgcaatgagtaacagcttctctccgccagcggctcctcccaccaattctgaactactgagtgacctgtttgggggtggaggtgcagctggtcccacccaggctggacagtcaggagtggaagatgtgtttcatcctagtggacctgcgtctacccagtcaacaccacgccgctctgccacctccacctctgcgtctccaaccctaagagtgggagaaggtgccacctttgacccatttggagcaccttctaaaccatcaggtcaggatttgctgggttcttttctgaacacatccagtgcttccagtgacccctttctccagccaacaagaagtccttcgcccacagtacatgcttctagtacgcctgctgtgaacattcagccagatgtttctggaggttgggactggcatgctaaaccaggaggctttggaatgggaagcaagtcagctgccaccagcccaaccggatcctcgcatggtactcccacccatcaaagcaaaccccagactctggatccttttgccgaccttgggacactaggtagttcttcctttgccagcaaacccaccacaccaactggattgggtggaggattcccgcctctcagctcgccacagaaggcgtctccccagcctatgggtggcgggtggcagcagggaggtgcctacaactggcagcagccacagcctaagcctcagcccagcatgccccactcctctccccagaaccgacccaactacaacgtgagcttctcagccatgcctgggggccagaacgaacgtgggaaaggatcaagtaatttggaagggaaacaaaaagcagctgattttgaagacctactctctggtcaaggtttcaatgctcacaaagacaaaaaggggcctcggacaatagctgagatgagaaaggaggaaatggccaaggaaatggatcctgagaaattaaagattctggaatggattgaaggcaaagaaagaaatatcagagcccttctttccacgatgcataccgtactatgggctggggagaccaagtggaaaccagttggcatggcagacctggtaacaccagagcaggtgaagaaggtgtacaggaaggctgtcctggtggtgcacccagataaagctactgggcaaccctatgaacaatacgcaaagatgattttcatggagctcaatgatgcctggtctgaatttgaaaaccaaggccaaaagcccttatattaatttatgagcttttccatctctgctgcagacctgtgctaatgcttagtgtgtgtcacaattctgaggttttcgcagatgaaccaaaaactccagtaacatgttttcagtactaaaccgttaagttactcatgaattaatttctcattgataaggaatgtggatgtttggtttctccaaagttcccaccataaaagatccaaagcatgagaggaacttctagtcagatgaccttgcagaaccaccgcattccaccctgccctttggggagcctactcagcattctacctggggaaatggaaaacagaggccaccacccatgaaggcataacacccatcacattgtctgagaataggattaatgagcaaaagttatgataatagagttatatgatggtttaatggtttctagatttttcttggaaagatataatttgagcagtggctttatgcagactccaagaacaaaaccaccaggtatttttttttaagtaaaaatttactaaggcctttagcataatactgtaaatgtcttttggtcaagagaactaacaaatataaaggaacttgaaatgtggggagtgataatagtccagtgattaaactacagtccagtgattaccaccaactttctgactaagctaaaaatgaatgaaaatggtggctaaagaaaatagggactctgaagatgtcgaaatctttattcctggttaggaaggtgggccgctacccttctttccctttagaaaactgtgattaattaaataaaaagtcttactactataacaactctaaacctggtttaaatgaaacatctaattttgctgtaaggcttaatgctcttcttttgtttagccaagaaaacattcttagttggaaacaggtggtaaagtagtttggcctgttcacaacttatcaggaccaatatctagtgtggactcagtgttctctaggtttgtgagcagttgtggtaagagaatggaaggcaacactgaataggagttaagggaatggcacgatcacagtgagagagctgcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagaccaacaggtctttgcattccttttaaataactggttgtgacaaagcttgttgttgatcagattcactgtttcatcatatttattgtaatatattttttgttttgtaaatatgttacaacaaaatgtgattggtctaaaatatttgtaatgtatattaaaaggttcaaaaatatttgtataaatctaagttatttgggtacttgtaggaatacaatgaggagcttgaatgccaccttctgacatgatttacttttaaggaaagttatgaggagagaatacaaaaagcatgcaccaaaatgtaatctgacaggatttctggatttatacgtaatcactcctgccccaacacacacacacacacacacacacacacacacacacatgcacgcacacatgattttgattatgctacatgatatatgtttcaaaaagaattagcatagaaatcctggtctcctagccaaaaaaatcaaaggattttcaaaaaaacgaatctgtatgttgaggcaaaaggattgaacctggaagtctgggactttatcatagaaacaaagtctcagatattttagttctttggaaacaaatgctgtaattcaaaagcatttgacctgtcactgtactatctacatgtggaagaatgttcaagttgaatcctaatgccgtgaatgaaacacagtctgtgtagggaatgagcaaaaaagttgaattccaattgctttttggccttttggctaaaataaatgtagcatctaattttatcagttt

SEQ ID NO: 127799 - DNA, 1621 bp, Homo sapiens
  Payload ID: 5016
  Gene Symbol: DNAJC6
  Gene Name: DnaJ (Hsp40) homolog, subfamily C, member 6
  ENST ID: ENST00000494710
  CDS Start-End: 74-1621
agacgcgcggcggcggcggcgagcggtggcgctcggctcgggcgaccgcggcgggggagggcgcggcgcaccgatgggcgccactgagaagggaggccagaagagccggaagctgttttccttgcggcggccgtggaaggcgacccggcggctgtggaggccacgctcagctcgccaggcggcgcagggtgcctcatctccagacatggagcccagctatgggggaggtctctttgacatggtaaaaggaggtgcagggaggctctttagtaacctaaaggacaacttgaaagacaccctcaaagacacatcttctagagtgatacaatctgtgaccagctacacaaagggagatttagacttcacttatgttacctccagaattattgtgatgtcctttcctctggacaatgttgacataggattcaggaatcaggttgatgacattcgaagctttttggattccagacatcttgaccactacacagtatacaatctgtcacctaagtcttatcgaactgccaagtttcacagccgggtctcagaatgcagttggcccattaggcaggctcccagtctgcacaacctttttgctgtgtgtcggaatatgtataactggctactgcagaatcccaaaaatgtctgtgttgtccactgcttggatggacgggcggcatcatcaattctggttggtgctatgttcattttctgtaatctctactctactcctggcccagccattcgattgctatatgcaaagcgaccaggaattggactttcaccatcccataggagatacctgggctatatgtgtgacctactggcagacaagccctaccgccctcacttcaagcctctcacaattaagtcgatcactgtcagtccaataccctttttcaacaaacagaggaatggatgtcgcccttactgtgatgtactcattggagaaaccaaaatatattcgacttgcacagattttgaacgaatgaaagaatatcgtgtccaagatggaaaaatcttcattcccttgaacatcactgtgcaaggagacgtggttgtttccatgtatcacttgaggtcaaccattgggagccggctacaggctaaggtgaccaacacacagatattccagcttcagtttcacactggattcataccactggacacaacagttttaaagttcaccaagcctgagttagatgcatgtgatgtaccagaaaaatatcctcagctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggacaggctccaatagatatccctccagacaaccccaggcattacggacaaagtggtttctttgcctctctctgttggcaagatcagaaatcggagaagtcattctgtgaggaggaccacgctgccctagtgaatcaggaaagtgagcaatcagatgatgaacttctgacactttccagtccgcatggcaatgccaatggtgacaagcctcatggagtcaagaagcccagcaaaaagcag

SEQ ID NO: 127800 - DNA, 1468 bp, Homo sapiens
  Payload ID: 5017
  Gene Symbol: DNAJC7
  Gene Name: DnaJ (Hsp40) homolog, subfamily C, member 7
  Uniprot ID: Q99615
  ENST ID: ENST00000316603
  CDS Start-End: 83-1399
aagatggcggctgccgcggagtgcgatgtggtaatggcggcgaccgagccggagctgctcgacgaccaagaggcgaagagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagtt

SEQ ID NO: 127801 - DNA, 1774 bp, Homo sapiens
  Payload ID: 5017
  Gene Symbol: DNAJC7
  Gene Name: DnaJ (Hsp40) homolog, subfamily C, member 7
  Uniprot ID: Q99615
  ENST ID: ENST00000426588
  CDS Start-End: 204-1520
gcttccgcctggcgtaggagctgaggcatggccttgttctccagctgagaggacgatcgtccttataggagaggccgagtctccgagggcaatttcagaggtctggtgcgagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttatt

SEQ ID NO: 127802 - DNA, 2022 bp, Homo sapiens
  Payload ID: 5017
  Gene Symbol: DNAJC7
  Gene Name: DnaJ (Hsp40) homolog, subfamily C, member 7
  Uniprot ID: Q99615
  ENST ID: ENST00000457167
  CDS Start-End: 238-1722
acgggtaaagtggcgccgcctacgcaccggcacagcccctgggctcccgccccggcgcggagaccaccgtggacatccgggggcgggaggccgctctggccccaagcggagcctctctctggtagacgagcccgagggagcccttctgggcgcggcgccgcggagctgctctatgctccaaccggaagtgctcttcaccgccggcctcccacccagctctctggtcccggcggtaagatggcggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttattaaaaaagaaaaaaaaaagagaataaaatgttttgacccttcctggc

SEQ ID NO: 127803 - DNA, 832 bp, Homo sapiens
  Payload ID: 5017
  Gene Symbol: DNAJC7
  Gene Name: DnaJ (Hsp40) homolog, subfamily C, member 7
  ENST ID: ENST00000590348
  CDS Start-End: 48-832
agtggtcgctgtggtttcagctccctccacactgggataggcagagtatgagcattggcacatgctgttttcctggaacaaacagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagc

SEQ ID NO: 127804 - DNA, 579 bp, Homo sapiens
  Payload ID: 5017
  Gene Symbol: DNAJC7
  Gene Name: DnaJ (Hsp40) homolog, subfamily C, member 7
  ENST ID: ENST00000586335
  CDS Start-End: 1-268
gaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtggtgggattgttccagccctagactatctttatagacctccagcggaggagattgcacaagctccctcagtctcccatgcctgtgtctaacgcccctcacgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctg

SEQ ID NO: 127805 - DNA, 566 bp, Homo sapiens
  Payload ID: 5017
  Gene Symbol: DNAJC7
  Gene Name: DnaJ (Hsp40) homolog, subfamily C, member 7
  ENST ID: ENST00000591787
  CDS Start-End: 345-566
accatcccaatgctagtcagaggaaacggatgtctccatgtctactactggatgtcccacgcctttgacatctcatccttcagtccctttgctgtaaaggcaacttgaacaagcttcagccctttctcagacttccagggcaggacttgaatggatttgacactggaattgttcctgatgcagccttgttcagttcttgctgctgccatgctggattccaaagatccactctttcctcgactggtctcgcaggggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgct

SEQ ID NO: 127806 - DNA, 678 bp, Homo sapiens
  Payload ID: 5017
  Gene Symbol: DNAJC7
  Gene Name: DnaJ (Hsp40) homolog, subfamily C, member 7
  ENST ID: ENST00000589773
  CDS Start-End: 372-678
gtcgctgtggtttcagctccctccacactgggataggcagagtatgagcattggcacatgctgttttcctggaacaaacagtcccacgcctttgacatctcatccttcagtccctttgctgtaaaggcaacttgaacaagcttcagccctttctcagacttccagggcaggacttgaatggatttgacactggaattgttcctgatgcagccttgttcagttcttgctgctgccatgctggattccaaagatccactctttcctcgactggtctcgcaggggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttc

SEQ ID NO: 127807 - DNA, 544 bp, Homo sapiens
  Payload ID: 5017
  Gene Symbol: DNAJC7
  Gene Name: DnaJ (Hsp40) homolog, subfamily C, member 7
  ENST ID: ENST00000590774
  CDS Start-End: 204-544
ctttcttaagttaagcaccaaggaagagggcaactgcttgggcgctgttggcactccgaagcagccgcagtggttcgagattgccagtcggactagccaagggagctgctgaggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctaga

SEQ ID NO: 127808 - DNA, 543 bp, Homo sapiens
  Payload ID: 5017
  Gene Symbol: DNAJC7
  Gene Name: DnaJ (Hsp40) homolog, subfamily C, member 7
  ENST ID: ENST00000590886
  CDS Start-End: 317-543
attgaagtttgtattttaatggttttgaaaagctgagtactgggcacttgcttttttgttcttcgggactttagaagtttggagaacaatagtcagcagttgcctagttgctttgtggcctgatgcagagtccctctgagagcccatttctcccttactgcactagtctttggtcccctttctccagcactgagtgatgtggaagttactcagaggtctttccagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggc

SEQ ID NO: 127809 - DNA, 1719 bp, Homo sapiens
  Payload ID: 5017
  Gene Symbol: DNAJC7
  Gene Name: DnaJ (Hsp40) homolog, subfamily C, member 7
  ENST ID: ENST00000588814
  CDS Start-End: 4-417
aagatggcggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagcttcattaaaactttcctatgtctgattttccggtgcagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcagggg

SEQ ID NO: 127810 - DNA, 620 bp, Homo sapiens
  Payload ID: 5017
  Gene Symbol: DNAJC7
  Gene Name: DnaJ (Hsp40) homolog, subfamily C, member 7
  ENST ID: ENST00000589586
  CDS Start-End: 309-620
gcctggcgtaggagctgaggcatggccttgttctccagctgagaggacgatcgtccttataggagaggccgagtctccgagggcaatttcagaggtctggtgcgagtgacaaatgcatgagccacttttcaggaggtgaaattattaaaactcttgaggatgtgacctatttcacattgagaaataagttgccctgaatggagtaaccatttttcctggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaag

SEQ ID NO: 127811 - DNA, 686 bp, Homo sapiens
  Payload ID: 5017
  Gene Symbol: DNAJC7
  Gene Name: DnaJ (Hsp40) homolog, subfamily C, member 7
  ENST ID: ENST00000585866
  CDS Start-End: 8-127
cggtaagatggcggctgccgcggagtgcgatgtggtaatggcggcgaccgagccggagctgctcgacgaccaagaggcgaagagtcccacgcctttgacatctcatccttcagtccctttgctgtaaaggcaacttgaacaagcttcagccctttctcagacttccagggcaggacttgaatggatttgacactggaattgttcctgatgcagccttgttcagttcttgctgctgccatgctggattccaaagatccactctttcctcgactggtctcgcaggggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaag

SEQ ID NO: 127812 - DNA, 1058 bp, Homo sapiens
  Payload ID: 5017
  Gene Symbol: DNAJC7
  Gene Name: DnaJ (Hsp40) homolog, subfamily C, member 7
  ENST ID: ENST00000589810
  CDS Start-End: 204-965
gcttccgcctggcgtaggagctgaggcatggccttgttctccagctgagaggacgatcgtccttataggagaggccgagtctccgagggcaatttcagaggtctggtgcgagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaaggaaactagatgatgcaatagaagactgcacaaatgcagtgaagcttgatgacacttacataaaagcctacttgagaagagctcagtggtgggattgttccagccc

SEQ ID NO: 127813 - DNA, 449 bp, Homo sapiens
  Payload ID: 5017
  Gene Symbol: DNAJC7
  Gene Name: DnaJ (Hsp40) homolog, subfamily C, member 7
  ENST ID: ENST00000587727
  CDS Start-End: 1-168
gacaagaatgcctctgaggacgagatcaagaaagcttatcggaaacgggccttgatgcaccatccagattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttattaaaaaagaaaaaaaaaagagaataaaa

SEQ ID NO: 127814 - DNA, 586 bp, Homo sapiens
  Payload ID: 5017
  Gene Symbol: DNAJC7
  Gene Name: DnaJ (Hsp40) homolog, subfamily C, member 7
  ENST ID: ENST00000589576
  CDS Start-End: 203-586
cttcctctcccgcttccgcctggcgtaggagctgaggcatggccttgttctccagctgagaggacgatcgtccttataggagaggccgagtctccgagggcaatttcagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaa

SEQ ID NO: 127815 - DNA, 782 bp, Homo sapiens
  Payload ID: 5017
  Gene Symbol: DNAJC7
  Gene Name: DnaJ (Hsp40) homolog, subfamily C, member 7
  ENST ID: ENST00000588641
  CDS Start-End: 8-782
cggtaagatggcggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactct

SEQ ID NO: 127816 - DNA, 1759 bp, Homo sapiens
  Payload ID: 5018
  Gene Symbol: DNAJC8
  Gene Name: DnaJ (Hsp40) homolog, subfamily C, member 8
  Uniprot ID: O75937
  ENST ID: ENST00000263697
  CDS Start-End: 28-789
gggtcacgtggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaagccattgatgtacttttccttgtactctcccttgtgggtcccttgtctggcttggctgaaccccaaaatgctttggggttggacagacctggctgaaccttagtttcttcatctatgaaatgggaatatgaattactgcagcagcttttagggcagatttgccatggcatatacaaggtaactaccatagtgctccttgggtattgccaatatcctattatttctgtgtaaaatgaagatactgattgttttgaggattaaatgaagtaatatatgaaa

SEQ ID NO: 127817 - DNA, 483 bp, Homo sapiens
  Payload ID: 5018
  Gene Symbol: DNAJC8
  Gene Name: DnaJ (Hsp40) homolog, subfamily C, member 8
  ENST ID: ENST00000603289
  CDS Start-End: 1-319
gttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacggacagaatcagccctcaggaggggcccaaagtgagaaggggaaaggtgacacttgaaatgtgaagatacaggaaactaggctttacaggaagcatggctggggaggcctcaggaaacttaacagttgtggcagaaggtgaagaggaaggaggcacgtcttacatggccggagcaggaggaagagagcgcagggagagg

SEQ ID NO: 127818 - DNA, 3032 bp, Homo sapiens
  Payload ID: 5019
  Gene Symbol: DNAJC9
  Gene Name: DnaJ (Hsp40) homolog, subfamily C, member 9
  Uniprot ID: Q8WXX5
  ENST ID: ENST00000372950
  CDS Start-End: 1674-2456
atttcagtgtgcgatttcaattttccgtagcaaatgtatatatagaaaaatgttaaaatagatgtatttgaataccttaaaaaatacaagaaactggaagaaagataatattgcaaagcatctacatatatcctaggccttttgtgtacaaggttatttgtgacaattgtaaggtattatgaaggcaggtaggattatctccgttttacagatagggaagctgaggcctagaggtggaaacttgcccagtgatgtaagattcatctcccggttatgccctcctggaaagcccttcccaacatattatgttgtccatagagggaaaaatgagcaaagacagatggcttaactctggtgtgtgactaagatataggaaatttatagaggaggttctatcaatgtgccgacttactttgtgttttatgttctgagaacgattaccagccatctcaaattctgtggttgtcaaagctcccctggggttgttgctggttggcccccacttgctttgagactttgatgccagggcaggttgagaggaactgacttcagctgagtttgatcttggatctgggaaagagaaatgctttgaaaatcacggcaactctgggaagtttaaaagatattaatgtatcctggagagtttgaggctttgcagaaacttattggcagagcagaatgattctgaaaaatgctacatcagtgaggggatatttgataaggtattttctgccaactcgggtattcacttagcattgtttatcctttaagatatgtatacacatacttcctctgtgagtttaccctactaacaaagttttatccccagcctcaaccttgctttgggtctccaggcccaagtttctcaccatctcttggatgattgctccagcccactctgctgccacctgggatccaacatgttcaaacccagctgtgaacttcacagagtattaaaagaaagagcctttgcttcagcagtttatgttattaagacggaggcttgggtcatgttatctctctccaccaatgtgtaaggtgaaagtcctattaggtaagagtttttggaagacccgtgttttgtgctttttgggtttcagtatagggttttttcctacagggctagagggaaagtaccccagcatttccaaccagtggggtgcaaaattatttgggtctacagctttacctattcctttcaagaacatttttgaaaaaacacatctgttaagttgaaccatgtgtaactgctgaatgctgatgtttggccgttttctacttaaaaaaataggccagcagtttgtaaattcaagctaatatatgaactttttgaaaaagttgttcttggacactaaaaggtaagacggacgccagatttccagagcaaggggaggagagacccgagcaacatcacttccctgaagacctagctcctgcgcgcggccggggactgtgactccacatgccggcgttacttacccgggcccgcgcctgactcgccacacctcattttgcggccgccgtaaagcgcggatgcgcggcgtggccacgccccttcagtgcttgtgacgcaggcgccctgggctttttgggcgcgaaaaagaagcagtcctgggttgtacccggcgcagctgggagcggctgcttcctccggggtcgtatctccgcccggcatggggctgctggacctttgcgaggaagtgttcggcaccgccgacctttaccgggtgctgggcgtgcgacgcgaggcctccgacggcgaggtccgacgaggctaccacaaggtgtccctgcaggtacacccggaccgggtgggtgagggcgacaaggaggacgccacccgccgcttccagatcctgggaaaagtctattccgttctcagtgacagagaacagagagcagtgtacgatgagcagggaacagtggacgaggactctcctgtgctcacccaagaccgagactgggaggcgtattggcggctactctttaaaaagatatctttagaggacattcaagcttttgaaaagacatacaaaggttcggaagaagagctggctgatattaagcaggcctatctggacttcaagggtgacatggatcagatcatggagtctgtgctttgcgtgcagtacacagaggaacccaggataaggaatatcattcagcaagctattgacgccggagaggtcccatcctataatgcctttgtcaaagaatcgaaacaaaagatgaatgcaaggaaaaggagggctcaggaagaggccaaagaagcagaaatgagcagaaaggagttggggcttgatgaaggcgtggatagcctgaaggcagccattcagagcagacaaaaggatcggcaaaaggaaatggacaattttctggctcagatggaagcaaagtactgcaaatcttccaaaggaggagggaaaaaatctgctctcaagaaagaaaagaaataatggaatttttctcttcaaaggtccttaggtgtaaattgatgccatcgtaggcaaggtgcaggcaggatttgaaggcaaaagtcaattcagctcttgagaaaaggtgtctttccagcctgaatttttcagattgactagaccaagcagaatctctcaacctgatcttagtatttcctagaaagcacttgacattgtgtgaggtctcacctgaaggaacttggtggtgacatttgggagggtggagggaggcagtgtccttcctgacagcacttgcctccatggatcttctgtacacagaactcttatctaggatgtggttctgttcatgctgctttctgcgatgtgcgtgtctgttagaataggctctctacccagctagaacaccttccagacacttgctggacagctatcttccacatacttcccagtttacatttggtcttaatgatcttgaatagatcctctcttcattttactcagccaggttttgtactgatgtacaggtgttaaattacttcaagcatttttgtaagaggtgtatataattcaataaaaaaggtaaaacatgatgattaa

SEQ ID NO: 127819 - DNA, 1448 bp, Homo sapiens
  Payload ID: 5020
  Gene Symbol: DNAJC25-GNG10
  Gene Name: DNAJC25-GNG10 readthrough
  ENST ID: ENST00000374294
  CDS Start-End: 23-484
agagccgccagcgaggctggggatgggggcgccgctgctctctcccggctggggagccggggctgccggccggcgctggtggatgctgctggcgcccctgctgccggcgctgctgctggtgcggcccgcgggggccctggtggaggggctctactgcggcacgcgggactgctacgaggtgctgggcgtgagccgctcggcgggcaaggcggagatcgcgcgggcctaccgccagctggcccggcgctaccaccctgaccgctaccggccccagcccggagacgagggccccgggcggacgccgcagagcgccgaggaggctttcctgctggtggcaaccgcctacgagacactcaaggtctctcaggcagctgcagagcttcaacagtactgtatgcagaatgcctgcaaggatgccctgctggtgggtgttccagctggaagtaaccccttccgggagcctagatcctgtgctttactctgaagactcgagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttttgtttatttaaacaactgaatacttataaactgttgttcctggaagttatttattccataaaaaatttgttcttttgtcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgccccatcgtgtatataaatgaagcagatttgatttttgtattcttacgtttctctgctttgtagttgtggctgtacttaaagaaatacagaatttcatatatttaaaaatgtttaaaatgtgacccacagaacattgtaaatgattaaaaactaacatgaaaatattacaacctaaaagaattcttaacttcacaagtgttttacttcgacgatgtgcctttgatttaatttgggacacttttttagaaggatacattattcgtgtttgcaacggtctttgaagagcttggaaataaaatttctgcttaattaatca

SEQ ID NO: 127820 - DNA, 1605 bp, Homo sapiens
  Payload ID: 5021
  Gene Symbol: DND1
  Gene Name: DND microRNA-mediated repression inhibitor 1
  Uniprot ID: Q8IYX4
  ENST ID: ENST00000542735
  CDS Start-End: 45-1106
ggaggaagttataaagagggtacgagggggccagctggagagccatgcagtccaagcgggattgtgagctgtggtgtgagagggtgaatccagagaacaaggcggcgctggaggcgtgggtcagggagacaggcatccgcctggtgcaggtgaacgggcagaggaagtatggcgggccacccccaggctgggtgggcagcccgccgccagctgggtcagaggtgttcatcgggcggctgcctcaggacgtgtacgagcaccagcttatcccgctgttccagcgcgtgggccgcctctacgagttccgcctgatgatgaccttcagcggcctgaaccgcggcttcgcctatgcccgctacagctcgaggcgcggcgcgcaggccgccatcgccacgctgcacaaccatccgctgcggccgtcctgcccgctgctcgtgtgccgcagcaccgagaagtgtgagctgagcgttgacggcctgccgccgaatctgacccgcagcgcgctgctgctcgcgctgcagccgctgggtcccggcttgcaggaggcgcggctgctgcccagccccggaccggcgcccgggcagatcgctctgctcaaattcagctcgcaccgggccgctgccatggccaaaaaggccctggtggaagggcagtcacacctctgtggagagcaggtggctgtggagtggctcaagccagacctgaagcagcgacttcgccagcagcttgtgggtcccttcttgcggtccccacagccagagggcagccagttggctttggcaagggacaagttagggttccaaggggctcgggctaccctgcagttgctgtgccaacgaatgaagctgggcagccctgtgttcctcaccaagtgtttgggcataggacctgctggctggcaccgcttctggtaccaggtggtgattcctgggcatccggtgcccttcagcggcctcatctgggttgtgctgaccctagatggccgggatgggcatgaggtggccaaggatgctgtgtctgtacggctgctgcaggcactcagtgagtctggggccaacctcctgtggtctgctggggctgaggcaggtaccatggttaaacagtgactccattctttctccacaggcaccctgaatgggcatgcagagcctgtgtcaggccccatcccagcaggcctgggtggccactttctgacccccaaaggtggggaggggcatgggcccaggcccatcagcctccctgctgggacagggacctatggcacctgggggcagcttaggtttgggttaagttgtggtgaggggccttgccctcccgctcccagcccagggtccaacctgacccagtgatcttccatggccgttccttgtcccacccccacccgatcataccttcccccctctgccacagcttagcatgaatcttctttattgtcctgatttgtcctctttgttggtttttatttgtggggaagggcagctgagccaaaggggtcagaaattctgccctttgcctccaccacatggcattctggttttggtttctgtatagttttgggtctttctatgctggttgtatttatattaaacccctggttagtatata

SEQ ID NO: 127821 - DNA, 724 bp, Homo sapiens
  Payload ID: 5022
  Gene Symbol: DNLZ
  Gene Name: DNL-type zinc finger
  Uniprot ID: Q5SXM8
  ENST ID: ENST00000371738
  CDS Start-End: 76-612
gcttccgcccggcgcccacttccaagatggcggcggggcggggccggggcagggcggacggagccggcgagcgggatgctgcggactgcgctgcgcggcgcgccgaggttgctgagtcgcgtgcagccccgggcgccctgcctgaggcggctgtggggccgcggggcccgtccagaggtcgcggggaggcggcgggcctgggcctggggctggcggcgctcaagctccgagcaggggccggggcccgcggcggctctggggcgcgtggaggcggcgcactaccagctcgtctacacctgcaaggtctgcgggactaggtcctccaagcgcatctccaagctggcctatcaccaaggcgtggtcattgtgacctgccccggctgccagaaccaccatatcatcgctgacaacctgggctggttctcggacctgaatgggaagagaaatatcgaagagatcctgacggccagaggcgagcaggtgcaccgtgtggcgggcgagggggccctggaactggttctggaggctgcaggggcccccacatccactgcagctccggaagcgggtgaggatgagggtccccccagccctggcaagacggagccgagctgactcctgcgctccccggcactgtgggacttcggccttccagaaggaggttttggccctgggcctctctggacgtggcctgttttctatcaataaacagacattacttccagat

SEQ ID NO: 127822 - DNA, 2934 bp, Homo sapiens
  Payload ID: 5022
  Gene Symbol: DNLZ
  Gene Name: DNL-type zinc finger
  ENST ID: ENST00000371739
  CDS Start-End: 6-359
gcgggatgctgcggactgcgctgcgcggcgcgccgaggttgctgagtcgcgtgcagccccgggcgccctgcctgaggcggctgtggggccgcggggcccgtccagaggtcgcggggaggcggcgggcctgggcctggggctggcggcgctcaagctccgagcaggggccggggcccgcggcggctctggggcgcgtggaggcggcgcactaccagctcgtctacacctgcaagaaatatcgaagagatcctgacggccagaggcgagcaggtgcaccgtgtggcgggcgagggggccctggaactggttctggaggctgcaggggcccccacatccactgcagctccggaagcgggtgaggatgagggtccccccagccctggcaagacggagccgagctgactcctgcgctccccggcactgtgggacttcggccttccagaaggaggttttggccctgggcctctctggacgtggcctgttttctatcaataaacagacattacttccagatgctggggcctgtggccctcgtggcctttctttttctggagttagaacgattgctctgaatccctggtgctgctgggtgggacataggagccgcaggacctctcgcctcaccacagttccttctacacagagtcacccagctcttgcccacagaggccacagtcgcgtggaaagggggctggatgtggcgtcagagcccttcctggctgtcgctgcgtgactttgagcaggtcaccacccctgtgagcctcagccttcctctgcaaggcccttgccgcccccctggccagctctggcggcctcccttccgtgagccagtgcagacctgagccctggtcctcggccgccggccgtcggcgaaacagtgagcaaaccaggctgcctgctggcccaggcaggacgagcagctatggcgtggccgtgtgttaggagctccagacccctcccgggggagccacctgggcctccttccctcggtggacagcgctctggacgtccccagggccctccgaggtgtgtggggtttgtctcccagccttgtctgtgcgcaggatgttcccgtgtttatgaaagcgagcaaacacagcagcctgtttatttgcagaagcgttctgggcagcgtaaccttcagcattcatcacccgccacactccggcagggaagagaatggggcgaggtgggaggtggaggcaggactgagcacgacagggacccagtgcggcccctcccagcgggacacggccaggactgccagctcacatccggcccgtgggaggccggggcgcggcggcatcgttcccagtgtgcttgtggcgtgggctttgcctcgattaccccctgtccttctttcagccaacaaccctctattattcccacccagagccttctgtgccatttgtggaaactgtcctcttctcggctgagccaccggcacccaggcctgctcctccatggaggcactggctgggggtctcttgggggcttggaagtgcagtggggctgggcttggcttggctgcctcactgcctccagagggcctggaccagcatgtggggaggtccagggagccgtctggacctggaagtgcagaattagagcaaggagagccgcttgggccaacccctcctcttacggatggggagatggcggctggtagttgggatgtggacgttaccatgtcttttctgtctgatgccagcacctctgggcccaggctggccctggagggaaatccttcccaaggctggcacgttcctagagaagacctatggctaccccccgcgtgccagaagcatcccgccagctcctgcctgaggccccctggaccctgtctccctccgcccttccctccccgcagccccaatcccacagccaggtttctgcaaggggctttgccatcctaatctcctgccactctacacccccccgccccaggacatccctgcctcccgggcacggttgctggcctgggcatccctcgtcacagcgtctctccaagcaggttcctcggccgcaccttcagaggctgtcccagccagtagcgtgggcggcactgctgcgcttccctggctgtgcgcggtcctgggccctgcacggttacttggaccctgtgtgcgtgtaccaccacacgcaagctggctgggaccctggacctggagtacacgttgattctggttcccaaggccccttctggggtggaggaggcaacggagtcaaccagcacagaggctgtggctgccaacatggccaggtgggctgtggcgaggggcagcaggactgcccggcgcacctgtgtgtcccctgacgggggccccgtgggggtgccacccaccacaagcagcgcccagacaagccccaagactgcagatctgccgtcggctcctccactgtggctcagtgtccagaccctgagcccagccggatcagactccaggaaaggacctccctcccccgggtgctgggtgggcggcagcaggctgggtcctcagggggtcgtggggctgacctgggggctgctgcttctgggggctggtcccggccacgtgagtgtcagctcagagcatgctctgtttccctaggggctgggagcgtgaggaggtaggggtgcaggaatcagtggtgacagcaggcagccacttcacccctctgtgccccagctcccccgtggttaaatgcagtgggaactccatctctctgaggtctcagagggcccagacagtgggtatctgtggacactttgcacagtgcagcctcttaccgggttaggcccccacccgggactaagcccatacggaccacactcacttggccgactttatttttcaggaaaaacagaaaaacaaatgtacctcttgggttggaaaggacccattgacaacatggcacagacgtgagcaataaatacgcacatacattcaagta

SEQ ID NO: 127823 - DNA, 2555 bp, Homo sapiens
  Payload ID: 5023
  Gene Symbol: DOK1
  Gene Name: docking protein 1, 62kDa (downstream of tyrosine kinase 1)
  Uniprot ID: Q99704
  ENST ID: ENST00000233668
  CDS Start-End: 670-2115
ctctgggtcctccctccccgtggagctggccactgccgcgccccctccccctccctggccctcccggctcgttcaatgaagctttctcttcccgcggcatggaggccaggcctctgcggtcagggagctgacatgcaagcggcggccgggcggcggggcggccccggtggtggcgggaagcggttcaaccccagccctccctccgagtcccgggccagcggagtctaaacagcccggctcgggcggggctgggggcgggcccggccagggtaaataaagccccggaggcccgtgtgggtctctccggtgcccggggcgctttcggggtgatgtcatggctttcactctgacgtcaccttgggcatatgacgtcacgcgcagccaccacgcccagaggccagggccctcgcgccaaaaccgaggactttcggtggagccactggcgcgcccccacgacggcgggtaggggcctggggtgctgcagctcccggctaatccgggggtctccaccattccttctcgctcctctccctcaccccaccgcgacccccccagcggctgccggcgggggccggggaggggcggaaactcctccagggaacccggccccgcctcccgccccgcctcccgccgcagggccaggaagcgcggaaggaaccgccgggggccatggacggagcagtgatggaagggccgctttttttgcagagtcagcgctttgggaccaagaggtggaggaagacctgggccgtgctctacccggccagtccccacggcgtagcgcggctcgagttctttgaccataaggggtcgagctctgggggtggccgagggagctcgcgccgcctggactgcaaagtgatccgtctggctgagtgtgtgagtgtggcccccgtcaccgtggagaccccccctgagcccggcgccactgccttccgcctggacactgctcagcgctcgcacctgctggcggccgacgcgccgtccagtgcagcctgggtgcagacgctgtgccgaaacgcctttccgaaaggcagctggactctggcgcctaccgataacccacctaagctttctgccctggagatgctggagaactccttgtacagccctacctgggaaggatcccaattctgggtaacggtgcagaggactgaggccgccgagcgctgtggcctgcatggctcctacgtgctgagggtggaggctgaaaggctgactctcctgaccgtgggggcccagagtcagatactggagccactcctgtcctggccctacactctgttgcgtcgctatggccgggacaaggtcatgttctctttcgaggccggccgccgctgcccctcaggccctggaaccttcaccttccagacggcacagggaaatgacatcttccaggcagttgagactgccatccaccggcagaaggcccagggaaaggccggacaggggcacgatgttctcagagctgactcccatgaaggggaggtggcagaggggaagttgccttccccacctggcccccaagagctcctcgacagtcccccagccctgtatgctgagcccttagactccctgcgcattgctccatgcccttcccaggactccctatactcagaccccttggacagcacgtctgctcaggcaggagagggagtacaacggaagaaacctctctattgggacttgtatgagcatgcgcagcagcagttgctgaaggccaagctgacagaccccaaagaggatcccatctatgatgaacctgagggcctggccccagtccctccccagggcctttatgatctgcctcgggagcccaaggatgcatggtggtgccaagctcgggtgaaggaggagggctatgagctcccctacaaccctgccactgatgactacgctgtgccaccccctcggagcacaaagcccctccttgctcccaagccccagggcccagccttccctgaacctggtactgcaactggcagtggcatcaaaagccacaactcagccctgtacagccaggtccagaagagcggggcctcagggagctgggactgtgggctctctagagtagggactgacaagactggggtcaagtcagagggctctacctgagaaggacggcaaggctgaggtggctaagggggaccatggggaggtggcactagggatcaaagaagatggttagaaccagcagaagccagagggtgggaggggccatgctgtgtgagaccaggggaccagagggatgggagagtcaagggaaggacaatcccaggaagtcctaagaagtggggcagatggcagggctgaggatgggctctgcatcccccaaagccatcccttccctacttccccaaatgaagggacggctgtgggaccaggtctgtggaaagtggtgcatggtcagaatgggtgcagtttgaggggcctgtgtggaggcctcagggagatgttggactgtgcctggatccttactcctgcattgttctttgccagagacctatttaaaaattttaaaattctcattaaagtcagcttgggtttaagaagtt

SEQ ID NO: 127824 - DNA, 1722 bp, Homo sapiens
  Payload ID: 5023
  Gene Symbol: DOK1
  Gene Name: docking protein 1, 62kDa (downstream of tyrosine kinase 1)
  Uniprot ID: Q99704
  ENST ID: ENST00000340004
  CDS Start-End: 25-558
gcgcggaaggaaccgccgggggccatggacggagcagtgatggaagggccgctttttttgcagagtcagcgctttgggaccaagaggtggaggaagacctgggccgtgctctacccggccagtccccacggcgtagcgcggctcgagttctttgaccataaggggtcgagctctgggggtggccgagggagctcgcgccgcctggactgcaaagtgatccgtctggctgagtgtgtgagtgtggcccccgtcaccgtggagaccccccctgagcccggcgccactgccttccgcctggacactgctcagcgctcgcacctgctggcggccgacgcgccgtccagtgcagcctgggtgcagacgctgtgccgaaacgcctttccgaaaggcagctggactctggcgcctaccgataacccacctaagctttctgccctggagatgctggagaactccttgtacagccctacctgggaaggtcatgttctctttcgaggccggccgccgctgcccctcaggccctggaaccttcaccttccagacggcacagggaaatgacatcttccaggcagttgagactgccatccaccggcagaaggcccagggaaaggccggacaggggcacgatgttctcagagctgactcccatgaaggggaggtggcagaggggaagttgccttccccacctggcccccaagagctcctcgacagtcccccagccctgtatgctgagcccttagactccctgcgcattgctccatgcccttcccaggactccctatactcagaccccttggacagcacgtctgctcaggcaggagagggagtacaacggaagaaacctctctattgggacttgtatgagcatgcgcagcagcagttgctgaaggccaagctgacagaccccaaagaggatcccatctatgatgaacctgagggcctggccccagtccctccccagggcctttatgatctgcctcgggagcccaaggatgcatggtggtgccaagctcgggtgaaggaggagggctatgagctcccctacaaccctgccactgatgactacgctgtgccaccccctcggagcacaaagcccctccttgctcccaagccccagggcccagccttccctgaacctggtactgcaactggcagtggcatcaaaagccacaactcagccctgtacagccaggtccagaagagcggggcctcagggagctgggactgtgggctctctagagtagggactgacaagactggggtcaagtcagagggctctacctgagaaggacggcaaggctgaggtggctaagggggaccatggggaggtggcactagggatcaaagaagatggttagaaccagcagaagccagagggtgggaggggccatgctgtgtgagaccaggggaccagagggatgggagagtcaagggaaggacaatcccaggaagtcctaagaagtggggcagatggcagggctgaggatgggctctgcatcccccaaagccatcccttccctacttccccaaatgaagggacggctgtgggaccaggtctgtggaaagtggtgcatggtcagaatgggtgcagtttgaggggcctgtgtggaggcctcagggagatgttggactgtgcctggatccttactcctgcattgttctttgccagagacctatttaaaaattttaaaattctcattaaagtcagcttgggtttaagaa

SEQ ID NO: 127825 - DNA, 1955 bp, Homo sapiens
  Payload ID: 5023
  Gene Symbol: DOK1
  Gene Name: docking protein 1, 62kDa (downstream of tyrosine kinase 1)
  Uniprot ID: Q99704
  ENST ID: ENST00000409429
  CDS Start-End: 505-1533
cgctggccggcagcgccagcgctggaatcgcccccgcgcctgggagtggcctcgcgaggccggcgcgcgccccggggccgaggaatccgcctgcccgcccaggcgtcggccacgagagagcgggagcctcgctggtccccatttcagaggtggaggaagacctgggccgtgctctacccggccagtccccacggcgtagcgcggctcgagttctttgaccataaggggtcgagctctgggggtggccgagggagctcgcgccgcctggactgcaaagtgatccgtctggctgagtgtgtgagtgtggcccccgtcaccgtggagaccccccctgagcccggcgccactgccttccgcctggacactgctcagcgctcgcacctgctggcggccgacgcgccgtccagtgcagcctgggtgcagacgctgtgccgaaacgcctttccgaaaggcagctggactctggcgcctaccgataacccacctaagctttctgccctggagatgctggagaactccttgtacagccctacctgggaaggatcccaattctgggtaacggtgcagaggactgaggccgccgagcgctgtggcctgcatggctcctacgtgctgagggtggaggctgaaaggctgactctcctgaccgtgggggcccagagtcagatactggagccactcctgtcctggccctacactctgttgcgtcgctatggccgggacaaggtcatgttctctttcgaggccggccgccgctgcccctcaggccctggaaccttcaccttccagacggcacagggaaatgacatcttccaggcagttgagactgccatccaccggcagaaggcccagggaaaggccggacaggggcacgatgttctcagagctgactcccatgaaggggaggtggcagaggggaagttgccttccccacctggcccccaagagctcctcgacagtcccccagccctgtatgctgagcccttagactccctgcgcattgctccatgcccttcccaggactccctatactcagaccccttggacagcacgtctgctcaggcaggagagggagtacaacggaagaaacctctctattgggacttgtatgagcatgcgcagcagcagttgctgaaggccaagctgacagaccccaaagaggatcccatctatgatgaacctgagggcctggccccagtccctccccagggcctttatgatctgcctcgggagcccaaggatgcatggtggtgccaagctcgggtgaaggaggagggctatgagctcccctacaaccctgccactgatgactacgctgtgccaccccctcggagcacaaagcccctccttgctcccaagccccagggcccagccttccctgaacctggtactgcaactggcagtggcatcaaaagccacaactcagccctgtacagccaggtccagaagagcggggcctcagggagctgggactgtgggctctctagagtagggactgacaagactggggtcaagtcagagggctctacctgagaaggacggcaaggctgaggtggctaagggggaccatggggaggtggcactagggatcaaagaagatggttagaaccagcagaagccagagggtgggaggggccatgctgtgtgagaccaggggaccagagggatgggagagtcaagggaaggacaatcccaggaagtcctaagaagtggggcagatggcagggctgaggatgggctctgcatcccccaaagccatcccttccctacttccccaaatgaagggacggctgtgggaccaggtctgtggaaagtggtgcatggtcagaatgggtgcagtttgaggggcctgtgtggaggcctcagggagatgttggactgtgcctggatccttactcctgcattgttctttgccagagacctatttaaaaattttaaaattctcattaaagtca

SEQ ID NO: 127826 - DNA, 747 bp, Homo sapiens
  Payload ID: 5023
  Gene Symbol: DOK1
  Gene Name: docking protein 1, 62kDa (downstream of tyrosine kinase 1)
  ENST ID: ENST00000429631
  CDS Start-End: 1-266
cgcggctcgagttctttgaccataaggggtcgagctctgggggtggccgagggagctcgcgccgcctggactgcaaagtgatccgtctggctgagtgtgtgagtgtggcccccgtcaccgtggagaccccccctgagcccggcgccactgccttccgcctggacactgctcagcgctcgcacctgctggcggccgacgcgccgtccagtgcagcctgggtgcagacgctgtgccgaaacgcctttccggatcccaattctgggtaacggtgcagaggactgaggccgccgagcgctgtggcctgcatggctcctacgtgctgagggtggaggctgaaaggctgactctcctgaccgtgggggcccagagtcagatactggagccactcctgtcctggccctacactctgttgcgtcgctatggccgggacaaggtcatgttctctttcgaggccggccgccgctgcccctcaggccctggaaccttcaccttccagacggcacagggaaatgacatcttccaggcagttgagactgccatccaccggcagaaggcccagggaaaggccggacaggggcacgatgttctcagagctgactcccatgaaggggaggtggcagaggggaagttgccttccccacctggcccccaagagctcctcgacagtcccccagccctgtatgctgagcccttagactccctgcgcattgctccatgcccttcccaggactccctatactcagaccc

SEQ ID NO: 127827 - DNA, 1936 bp, Homo sapiens
  Payload ID: 5024
  Gene Symbol: DOK2
  Gene Name: docking protein 2, 56kDa
  Uniprot ID: O60496
  ENST ID: ENST00000276420
  CDS Start-End: 260-1498
ctaactcactggaaatgcaggaagcttgagtataaaactcactcagaaaaaaaaaaaaaaaagaaaaaaaagaacacacactcagaagaaaccgcagggcctatcagcctgtcgtcatcgagcagactagaatagtatagaaaaccctaggcagagaggaaatgaacttcagagaagggaaacacacggctaagaagagagaggcaagggcaggagtgaaggagagagctgaagcctggggctccgagatggtcagaggatgggagacggggcagtgaaacaaggcttcttgtatcttcagcagcagcagacgtttggaaagaaatggcgccgcttcggcgcctcactgtatggagggtcggactgcgccttggcccggctggagctgcaggagggcccggagaagcctcgtcggtgtgaggctgcccggaaggtcatccgcctcagtgactgcctgcgggtggccgaggccggcggagaggccagcagcccccgggacaccagtgccttcttcctggagaccaaggagcgcctgtacctcctggcggcccctgcagcggagcgcggcgactgggtgcaggccatctgcctcctggccttccccgggcagaggaaggagctctcggggccagagggaaagcagagccggccctgcatggaggaaaatgaattgtacagcagcgcagtcacagtcggcccccacaaggaatttgctgtgaccatgagacctacagaagccagtgagaggtgccacctgcgggggtcctataccctccgggctggggagagtgccctggagctgtggggtgggcccgagccagggacccagctgtacgactggccctacaggtttctgcggcgctttgggcgggacaaggtaaccttttcctttgaggcaggccgtcgctgcgtctctggagagggcaactttgagttcgaaacccggcaaggcaatgagatcttcttggccctggaagaggccatctctgcccagaagaatgctgcacccgctacaccccaaccgcagccagccacaatccccgcgtcgctgccccggcctgatagcccctactctcggccgcatgactcactgccgccgccttcacccaccacaccggtgcctgctccacggcctcggggccaggagggggagtatgccgtgcccttcgatgcggtggcccgttccttggggaagaacttcaggggcatcttggcagtccctcctcagctcctggccgaccctctgtacgacagcattgaggagaccctgccccctcgacctgaccacatatacgatgagcccgagggagtggctgccctgtccctctatgacagcccgcaggagccccggggtgaggcatggaggaggcaggcgacagctgacagggaccctgctggcctccagcatgtccagccagccgggcaggatttctctgcttctggctggcagccaggaactgagtatgacaatgttgtactaaagaaaggcccaaagtgacagaggcagcagagggatggtccaccgccccttggcttctgctggtgactcctcctggccactgcatcagaagaacctcctctgccccttctggagcccgaggcctggcctgtcttcgttggggctgataaattgcctctcccagggcctgctgggtgagtcaccatcccaaagcaggaagggtgccctggagagaaccaccctcctcctactctttttccacttcctcctctttctttccccagctgaggaggaacctggggcatttagggcagaggacaaaaggatgtcagcaattgcttgggctgcttggctatgcaagcctcctgcctgctgatggccacttcagggacagcctgggcccaggcacccagggggatggcggcagcttcctgcacctttcagatttcttggtggcattaaagcattttcagaaca

SEQ ID NO: 127828 - DNA, 774 bp, Homo sapiens
  Payload ID: 5024
  Gene Symbol: DOK2
  Gene Name: docking protein 2, 56kDa
  ENST ID: ENST00000523932
  CDS Start-End: 76-774
cacggctaagaagagagaggcaagggcaggagtgaaggagagagctgaagcctggggctccgagatggtcagaggatgggagacggggcagtgaaacaaggcttcttgtatcttcagcagcagcagacgtttggaaagaaatggcgccgcttcggcgcctcactgtatggagggtcggactgcgccttggcccggctggagctgcaggagggcccggagaagcctcgtcggtgtgaggctgcccggaaggtcatccgcctcagtgactgcctgcgggtggccgaggccggcggagaggccagcagcccccgggacaccagtgccttcttcctggagaccaaggagcgcctgtacctcctggcggcccctgcagcggagcgcggcgactgggtgcaggccatctgcctcctggccttccccgggcagaggaaggagctctcggggccagagggaaagcagagccggccctgcatggaggaaaatgaattgtacagcagcgcagtcacagtcggcccccacaaggaatttgctgtgaccatgagacctacagaagccagtgagaggtgccacctgcgggggtcctataccctccgggctggggagagtgccctggagctgtggggtgggcccgagccagggacccagctgtacgactggccctacaggtttctgcggcgctttgggcgggacaaggccgtcgctgcgtctctggagagggcaactttgagttcgaaacccggcaaggcaatgagatcttcttggccctggaagagg

SEQ ID NO: 127829 - DNA, 936 bp, Homo sapiens
  Payload ID: 5024
  Gene Symbol: DOK2
  Gene Name: docking protein 2, 56kDa
  ENST ID: ENST00000517422
  CDS Start-End: 90-461
agagaagggaaacacacggctaagaagagagaggcaagggcaggagtgaaggagagagctgaagcctggggctccgagatggtcagaggatgggagacggggcagtgaaacaaggcttcttgtatcttcagcagcagcagacgtttggaaagaaatggcgccgcttcggcgcctcactgtatggagggtcggactgcgccttggcccggctggagctgcaggagggcccggagaagcctcgtcggtgtgaggctgcccggaaggtcatccgcctcagtgactgcctgcgggtggccgaggccggcggagaggccagcagcccccgggacaccagtgccttcttcctggagaccaaggagcgcctgtacctcctggcggcccctgcagcggagcgcggcgactgggtgcaggccatctgcctcctggccttcccctcggcccccacaaggaatttgctgtgaccatgagacctacagaagccagtgagaggtgccacctgcgggggtcctataccctccgggctggggagagtgccctggagctgtggggtgggcccgagccagggacccagctgtacgactggccctacaggtttctgcggcgctttgggcgggacaaggtaaccttttcctttgaggcaggccgtcgctgcgtctctggagagggcaactttgagttcgaaacccggcaaggcaatgagatcttcttggccctggaagaggccatctctgcccagaagaatgctgcacccgctacaccccaaccgcagccagccacaatccccgcgtcgctgccccggcctgatagcccctactctcggccgcatgactcactgccgccgccttcacccaccacaccggtgcctgctccacggcctcggggccaggagggggagtatgccgtgcccttcgatgcggtggcccgttccttggggaa

SEQ ID NO: 127830 - DNA, 607 bp, Homo sapiens
  Payload ID: 5024
  Gene Symbol: DOK2
  Gene Name: docking protein 2, 56kDa
  ENST ID: ENST00000518197
  CDS Start-End: 155-607
agagaggcaagggcaggagtgaaggagagagctgaagcctggggctccgagatggtcagaggatgggagacggggcagtgaaacaaggcttcttgtatcttcagcagcagcagacgtttggaaagtcggcccccacaaggaatttgctgtgaccatgagacctacagaagccagtgagaggtgccacctgcgggggtcctataccctccgggctggggagagtgccctggagctgtggggtgggcccgagccagggacccagctgtacgactggccctacaggtttctgcggcgctttgggcgggacaaggtaaccttttcctttgaggcaggccgtcgctgcgtctctggagagggcaactttgagttcgaaacccggcaaggcaatgagatcttcttggccctggaagaggccatctctgcccagaagaatgctgcacccgctacaccccaaccgcagccagccacaatccccgcgtcgctgccccggcctgatagcccctactctcggccgcatgactcactgccgccgccttcacccaccacaccggtgcctgctccacggcctcggggccaggagggggagtatgccgtgcccttcgatgcg

SEQ ID NO: 127831 - DNA, 2292 bp, Homo sapiens
  Payload ID: 5025
  Gene Symbol: DOK3
  Gene Name: docking protein 3
  Uniprot ID: Q7L591
  ENST ID: ENST00000312943
  CDS Start-End: 162-1154
cccatgtggactggatgcccagcgtgagtgtataccgtgagggcctttgagctctcggacagcgtggagtggtcaagggaggcctccaggaggaagaggtggccaaccgccccaggcagcacagtggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccgacaagatacttctgggaaccccaggcgtcagtctcctcatctgtaaaggagagagaaccgatgacgtatcaggcataatccttgatgagagtttgctgcgtgcctactcagtgccaggcgctgggggacacagccgtgttcaggacagccttggtcctgttctccgggagccgacattccagggggagagaagtttcctgaagacttccatgctgcgttccctcctctgctcctgctcctggcgccatcctaggagccagccacgcacgcaagcgtcatgcctccagggctctgactgcccagcccctcaccgcaactccacctcagctgcacacacccttggcacatcctgaacctcattttcatgacggacacacaatttttgctctctcctgtccaagcctcatcctctggccgccacctccttccagctcacttcctttagtgcggccagtaccgcccctgcctaggcatgtcgacctgcagggacccttttctggctcttcgaggcctctgcccaccatcccctctttgttctccatagtcccttccccctgttctctctcgtttcatcttactggtctggcaaagtccccggccttgggcgagcccagacctcctcagtgcctgcacacagctgcccacagccagagaaatccatttaagcagactgcctgcatccttcttaacagtgcaaggcaggcactccctgccacaagagaccctgttccctagtagggcagcttttctcctccccagaacctcctgtctatccccacccaatgtctcctcacaggcatattggggaaacaggtcgggctctcccaccgtatctgcaagtgtactggcatccatctgtcttcttcctacccctacagtagaaacagtgtctgtccccagctgtgctctgatcccggctcctttcacctcagagcttggaaaattgagctgtccccactctctcctgcgcccattcatcctaccagcagcttttccagccacacgcaaacatgctctgtaatttcacattttaaaccttcccttgacctcacattcctcttcggccacctctgtttctctgttcctcttcacagcaaaaactgttcaaaagagttgttgattactttcatttccactttctcacccccattctcccctcaattaactctccttcatccccatgatgccattatgtggcttttattagagtcaccaaccttattctccaaaacaaaagcaacaaggactttgacttctcagcagcactcggctctggttcttgaaacacccccgttacttgctattcctcctacctcataacaatctccttcccagcctctactgctgccttctctgagttcttcccagggtcctaggctcagatgtagtgtagctcaaccctgctacacaaagaatctcctgaaagcctgtaaaaatgtccatgcatgttctgtgagtgatctaccaagaaaataaaaaattttaaaaatc

SEQ ID NO: 127832 - DNA, 1729 bp, Homo sapiens
  Payload ID: 5025
  Gene Symbol: DOK3
  Gene Name: docking protein 3
  Uniprot ID: Q7L591
  ENST ID: ENST00000357198
  CDS Start-End: 6-1496
aactcatgactcggggagccagactgcgatcagacgcgcgtgcccagctgaaccagctgtctctagacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccgacaagggcgtgttctcctttgaggccggccgtcgctgccactcgggtgagggcctctttgccttcagcaccccctgtgcccctgacctgtgcagggctgtggccggggccatcgcccgccagcgggagcggctgccagagctgaccaggccccagccctgccccctgccacgggccacctctctgccctccctggacacccccggagagcttcgggagatgccaccaggacctgagccacccacgtccaggaaaatgcacctggccgagcccggaccccagagcctgccgctactgctaggcccggagcccaacgatctggcgtccgggctctacgcttcagtgtgcaagcgtgccagtgggcccccaggcaatgagcacctctatgagaacctgtgtgtgctggaggccagccccacgctgcacggtggggaacctgagccgcacgagggccccggcagccgcagccccacaaccagtcccatctaccacaacggccaggacttgagctggcccggcccggccaacgacagtaccctggaggcccagtaccggcggctgctggagctggatcaggtggagggcacaggccgccctgaccctcaggcaggtttcaaggccaagctggtgaccctgctgagtcgtgagcggaggaagggcccagccccttgtgaccggccctgaacgcccagcagagtggtggccagaggggagaggtgctccccctgggacaggagggtgggctggtgggcaaacattgggcccatgcagacacacgcctgtgtccaccctggcctgcaggaacaaggcaggccgcctgtggaggacctcagccctgccctgccctcctcatgaatagtgtgcagactcacagataataaagctcagagcagctcccggcaggggcactcacggca

SEQ ID NO: 127833 - DNA, 1884 bp, Homo sapiens
  Payload ID: 5025
  Gene Symbol: DOK3
  Gene Name: docking protein 3
  Uniprot ID: Q7L591
  ENST ID: ENST00000377112
  CDS Start-End: 241-927
atgtggactggatgcccagcgtgagtgtataccgtgagggcctttgagctctcggacagcgtggagtggtcaagggaggcctccaggaggaagaggtggccaaccgccccaggcagcacagtgctgtctctagacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctctaccagcagcatgtcaagtttggcaaggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccgacaagatacttctgggaaccccaggcgtcagtctcctcatctgtaaaggagagagaaccgatgacgtatcaggcataatccttgatgagagtttgctgcgtgcctactcagtgccaggcgctgggggacacagccgtgttcaggacagccttggtcctgttctccgggagccgacattccagggggagagaagtttcctgaagacttccatgctgcgttccctcctctgctcctgctcctggcgccatcctaggagccagccacgcacgcaagcgtcatgcctccagggctctgactgcccagcccctcaccgcaactccacctcagctgcacacacccttggcacatcctgaacctcattttcatgacggacacacaatttttgctctctcctgtccaagcctcatcctctggccgccacctccttccagctcacttcctttagtgcggccagtaccgcccctgcctaggcatgtcgacctgcagggacccttttctggctcttcgaggcctctgcccaccatcccctctttgttctccatagtcccttccccctgttctctctcgtttcatcttactggtctggcaaagtccccggccttgggcgagcccagacctcctcagtgcctgcacacagctgcccacagccagagaaatccatttaagcagactgcctgcatccttcttaacagtgcaaggcaggcactccctgccacaagagaccctgttccctagtagggcagcttttctcctccccagaacctcctgtctatccccacccaatgtctcctcacaggcatattggggaaacaggtcgggctctcccaccgtatctgcaagtgtactggcatccatctgtcttcttcctacccctacagtagaaacagtgtctgtccccagctgtgctctgatcccggctcctttcacctcagagcttggaaaattgagctgtccccactctctcctgcgcccattcatcctaccagcagcttttccagccacacgcaaacatgctctgtaatttcacattttaaaccttcccttgacctcacattcctcttcggccacctctgtttctctgttcctcttcacagcaaaaactgttcaaaagagttgttgattactttcatttccactttctcacccccattctcccctcaattaactctccttcatccccatgatgccattatgtggcttttattagagtcaccaaccttattctccaaaacaaaagcaacaaggactttgacttctcagcagcactcggctctggttcttgaaacacccccgttacttgctattcctcc

SEQ ID NO: 127834 - DNA, 1872 bp, Homo sapiens
  Payload ID: 5025
  Gene Symbol: DOK3
  Gene Name: docking protein 3
  ENST ID: ENST00000501403
  CDS Start-End: 351-1673
atgtggactggatgcccagcgtgagtgtataccgtgagggcctttgagctctcggacagcgtggagtggtcaagggaggcctccaggaggaagaggtggccaaccgccccaggcagcacagtggtgagggggccctggaggggctggcctgggggagatgcaggccagaacacacaggtccctgagtgttgggctgaggagcctgggctgcaccccaggaaggggagagacagctgtctctagacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccgacaagggcgtgttctcctttgaggccggccgtcgctgccactcgggtgagggcctctttgccttcagcaccccctgtgcccctgacctgtgcagggctgtggccggggccatcgcccgccagcgggagcggctgccagagctgaccaggccccagccctgccccctgccacgggccacctctctgccctccctggacacccccggagagcttcgggagatgccaccaggacctgagccacccacgtccaggaaaatgcacctggccgagcccggaccccagagcctgccgctactgctaggcccggagcccaacgatctggcgtccgggctctacgcttcagtgtgcaagcgtgccagtgggcccccaggcaatgagcacctctatgagaacctgtgtgtgctggaggccagccccacgctgcacggtggggaacctgagccgcacgagggccccggcagccgcagccccacaaccagtcccatctaccacaacggccaggacttgagctggcccggcccggccaacgacagtaccctggaggcccagtaccggcggctgctggagctggatcaggtggagggcacaggccgccctgaccctcaggcaggtttcaaggccaagctggtgaccctgctgagtcgtgagcggaggaagggcccagccccttgtgaccggccctgaacgcccagcagagtggtggccagaggggagaggtgctccccctgggacaggagggtgggctggtgggcaaacattgggcccatgcagacacacgcctgtgtccaccctggcctgcaggaacaaggcaggccgcctgtggaggacctcagccctgccctgccctcctcatgaatagtgtgcagactcacagataataaag

SEQ ID NO: 127835 - DNA, 721 bp, Homo sapiens
  Payload ID: 5025
  Gene Symbol: DOK3
  Gene Name: docking protein 3
  ENST ID: ENST00000510380
  CDS Start-End: 81-721
cggggagccagactgcgatcagacgcgcgtgcccagctgaaccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcaggaagtgggcgagtttcccgtggtggtgcagaggactgaggccgccacccgctgccagctgaaggggccggccctgctggtgctgggcccagacgccatccagctgagggaggccaagggcacccaggccctctacagctggccctaccacttcctgcgcaagttcggctccga

SEQ ID NO: 127836 - DNA, 577 bp, Homo sapiens
  Payload ID: 5025
  Gene Symbol: DOK3
  Gene Name: docking protein 3
  ENST ID: ENST00000506493
  CDS Start-End: 108-577
atcagacgcgcgtgcccagctgaaccaggtgcgtgagaaggctgccttcaggtggccgggggctccctccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtccccatggaggaaaactccatctactcctcctggcagga

SEQ ID NO: 127837 - DNA, 545 bp, Homo sapiens
  Payload ID: 5025
  Gene Symbol: DOK3
  Gene Name: docking protein 3
  ENST ID: ENST00000502885
  CDS Start-End: 114-545
agacgcgcgtgcccagctgaaccaggtgcgtgagaaggctgccttcaggtggccgggggctccctccagtctccccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggcgagagctgcccccgggacaccggtgccttcctgctcaccaccaccgagcgaagccatctactggctgctcagcaccgccaggcctggatgggccccatctgccagctggccttcccggggacaggggaggcctcctcaggatccacagatgcccagtctcccaagaggggcctggtc

SEQ ID NO: 127838 - DNA, 603 bp, Homo sapiens
  Payload ID: 5025
  Gene Symbol: DOK3
  Gene Name: docking protein 3
  ENST ID: ENST00000509310
  CDS Start-End: 473-603
actcttcctgtcagggctgtgatgtttcagggacttctcctgaagccccttgggaggctgcttcttgcctcaggacccccacccactgcctgcctgtgccagccacctggagggagccctccattccgttgactgaggaggcagcagatgtcatagaactgccatttaggccacaagctctccctaagcctgctctgtgcccagctctgctgagctgtgaggacctagatgggccagggagatggctgcctgggaagccgtcaggcgaggggagagaaagacgcacacgcagaaacgtggacggcagtcacaagaccgctagcagatgaggcaggatctcagcatctggtgagagctgtctctagacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctgga

SEQ ID NO: 127839 - DNA, 467 bp, Homo sapiens
  Payload ID: 5025
  Gene Symbol: DOK3
  Gene Name: docking protein 3
  ENST ID: ENST00000510898
  CDS Start-End: 213-467
atgactcggggagccagactgcgatcagacgcgcgtgcccagctgaaccaggtgcgtgagaaggctgccttcaggtggccgggggctccctccagctgtctctagacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctctaccagcagcatgtcaagtttggcaagaagtgctggcggaaggtgtgggctctgctgtatgcaggaggcccatcaggcgtggcacggctggagagctgggaggtccgggatggtggcctgggagcagcgggtgacaggtcggcagggcctggccggcgaggggagcgacgggtcatccgcctggctgactgtgtgtccgtgctgccggctgacggc

SEQ ID NO: 127840 - DNA, 543 bp, Homo sapiens
  Payload ID: 5025
  Gene Symbol: DOK3
  Gene Name: docking protein 3
  ENST ID: ENST00000510389
  CDS Start-End: 505-543
ctgtcagggctgtgatgtttcagggacttctcctgaagccccttgggaggctgcttcttgcctcaggacccccacccactgcctgcctgtgccagccacctggagggagccctccattccgttgactgaggaggcagcagatgtcatagaactgccatttaggccacaagctctccctaagcctgctctgtgcccagctctgctgagctgtgaggacctagatgggccagggagatggctgcctgggaagccgtcaggcgaggggagagaaagacgcacacgcagaaacgtggacggcagtcacaagaccgctagcagatgaggcaggatctcagcatctggtgagagaggtggtgctgaatgacctgaggctgttccagaataaagctgtctctagacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctc

SEQ ID NO: 127841 - DNA, 2772 bp, Homo sapiens
  Payload ID: 5026
  Gene Symbol: DOK4
  Gene Name: docking protein 4
  Uniprot ID: Q8TEW6
  ENST ID: ENST00000340099
  CDS Start-End: 373-1353
gcggagtcccagccggagccccagccggagcccgatccctagccctgcggccgcgcctccctcgccgtccccgcctggagcccggcgccgccgccgccctgccgcccccgccagccgcgccgtgacgcgggcatgagcctgctccgcggcgccgctgagcaggcgctcctggcccgggcctcggcgcccagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtgtccatcctccatggcacagccctcctgctgccaggacctgcttgaactaccagggccacaggagggggataatcagagcttgaggctggcactctgactgctggcttttcccagacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccccacatggtgctgaggctccctgctgcaatgcaattaaagcaattgattttctagtgctggtatttgttgactaccatgcagaagggctatctttctattcacgtcaaacttttggttgtgtggggttttttgttgttttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaagacaa

SEQ ID NO: 127842 - DNA, 751 bp, Homo sapiens
  Payload ID: 5026
  Gene Symbol: DOK4
  Gene Name: docking protein 4
  ENST ID: ENST00000566705
  CDS Start-End: 516-751
agacgacactgagatggtgtccaggtagggctgttcctgcagccctgataagatccgatctgtcaggggtggggaggcccagccaggcaggcagccgctcgctcagtcattggttgccagcctcagcgcgtttgttctggagccaaagcctccaggcagaatccatgtgcgagagggagtgctcagcatggctgccctgtggggcaggtgggcagtgagggccctgggagtctccctactccccgccaccccaggacaccagcccttcctggggagaggagcattttggagctggctctccctgcgcggaaacctgtggtggcctggcaccaggcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggc

SEQ ID NO: 127843 - DNA, 1848 bp, Homo sapiens
  Payload ID: 5026
  Gene Symbol: DOK4
  Gene Name: docking protein 4
  Uniprot ID: Q8TEW6
  ENST ID: ENST00000569548
  CDS Start-End: 368-1348
ggttttcctgaatggttctgtcgtcctggggtggggagggaagggaaggaagaagggcgggaggaaggagggagggaagagggagagaggaggagtgtgggaagaggaaggaaaaaagagagcgagacagcgagaggaagagaaagatgtcactgtctctaatctccctgtcatttttatttccagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtgtccatcctccatggcacagccctcctgctgccaggacctgcttgaactaccagggccacaggagggggataatcagagcttgaggctggcactctgactgctggcttttcccagacagcccaaggg

SEQ ID NO: 127844 - DNA, 539 bp, Homo sapiens
  Payload ID: 5026
  Gene Symbol: DOK4
  Gene Name: docking protein 4
  ENST ID: ENST00000567175
  CDS Start-End: 379-539
aatttgcatttctaacaagtttcaaggtgatgggaagcttctggtccagggactacactttgagaagccctggtgtaaaaaggtacagacgtgaaaaccagaggggggacagctcctccccagaggaggcactgggcaacttctcttgtccctgcctggcacagctgaggcctgtgactggggattccgacagatcacaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccg

SEQ ID NO: 127845 - DNA, 2851 bp, Homo sapiens
  Payload ID: 5026
  Gene Symbol: DOK4
  Gene Name: docking protein 4
  ENST ID: ENST00000566936
  CDS Start-End: 299-1396
gggagggaagagggagagaggaggagtgtgggaagaggaaggaaaaaagagagcgagacagcgagaggaagagaaagatgtcactgtctctaatctccctgtcatttttatttccagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgagtcgcttccatgccccacacccacctgccaggaggctttgtggaggatgaggcctattgggcaggggtcttttgacctagctctgagttctgagcctgcttctgtgcccacaggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtgtccatcctccatggcacagccctcctgctgccaggacctgcttgaactaccagggccacaggagggggataatcagagcttgaggctggcactctgactgctggcttttcccagacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccccacatggtgctgaggctccctgctgcaatgcaattaaagcaattgattttctagtgctggtatttgttgactaccatgcagaagggctatctttctattcacgtcaaacttttggttgtgtggggttttttgttgttttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaagacaacttctgttaatcaataaatatcctttcctttctgta

SEQ ID NO: 127846 - DNA, 586 bp, Homo sapiens
  Payload ID: 5026
  Gene Symbol: DOK4
  Gene Name: docking protein 4
  ENST ID: ENST00000569250
  CDS Start-End: 221-586
ttttcctcactgccgcctccacctcggttttcctgaatgcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctggga

SEQ ID NO: 127847 - DNA, 558 bp, Homo sapiens
  Payload ID: 5026
  Gene Symbol: DOK4
  Gene Name: docking protein 4
  ENST ID: ENST00000569538
  CDS Start-End: 259-558
gcatttctaacaagtttcaaggtgatgggaagcttctggtccagggactacactttgagaagccctggtgtaaaaagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggca

SEQ ID NO: 127848 - DNA, 814 bp, Homo sapiens
  Payload ID: 5026
  Gene Symbol: DOK4
  Gene Name: docking protein 4
  ENST ID: ENST00000561659
  CDS Start-End: 250-429
agagcgagacagcgagaggaagagaaagatgtcactgtctctaatctccctgtcatttttatttccagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggtaggaccctctcgcctcccagccctgtcctactatggtgtgatggtggctgccattcactctgtgttgggcactgtgcta

SEQ ID NO: 127849 - DNA, 495 bp, Homo sapiens
  Payload ID: 5026
  Gene Symbol: DOK4
  Gene Name: docking protein 4
  ENST ID: ENST00000562008
  CDS Start-End: 265-495
gtgcggaagagttgcagggcctgggaacaggccctgcgtgagctcgaggtagtgattcttagcctggggctggagagaaacagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcgg

SEQ ID NO: 127850 - DNA, 549 bp, Homo sapiens
  Payload ID: 5026
  Gene Symbol: DOK4
  Gene Name: docking protein 4
  ENST ID: ENST00000568617
  CDS Start-End: 210-549
ttttcctgaatggttctgtcgtcctgggcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggt

SEQ ID NO: 127851 - DNA, 579 bp, Homo sapiens
  Payload ID: 5026
  Gene Symbol: DOK4
  Gene Name: docking protein 4
  ENST ID: ENST00000567214
  CDS Start-End: 270-579
gactctgccctcccacccaggaagcagcacccagagctgcgtgcggaagagttgcagggcctgggaacaggccctgcgtgagctcgagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggt

SEQ ID NO: 127852 - DNA, 920 bp, Homo sapiens
  Payload ID: 5026
  Gene Symbol: DOK4
  Gene Name: docking protein 4
  ENST ID: ENST00000562737
  CDS Start-End: 574-920
gaagctctgtgtcccaagtgggcaagcaggtgcctcatgaattcatttcctcatttaaagtaggtagatttattctcatttttttccaatggggaaattaaggcacagggtcttaagcggcttgcccaggaccacacagccagctggattcacactccgggctgtgctatgtctgagctatgttggatgaacctgggggtccagtggcttcctgtaggcgtgttctgactgggggcttccacactgtagacccacagccagtggtcagcctgctaatcatcttggagaggaactcctgagctggtccttgctctgaggagaaggcagccccagaggcaggcggtgaagacagagctgagaaaattgacccatctctggctgccagagcccagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcct

SEQ ID NO: 127853 - DNA, 564 bp, Homo sapiens
  Payload ID: 5026
  Gene Symbol: DOK4
  Gene Name: docking protein 4
  ENST ID: ENST00000566588
  CDS Start-End: 226-564
gacagatcagtgagtcaaccactgcacaggcccgaagggcagagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctgggg

SEQ ID NO: 127854 - DNA, 546 bp, Homo sapiens
  Payload ID: 5026
  Gene Symbol: DOK4
  Gene Name: docking protein 4
  ENST ID: ENST00000567276
  CDS Start-End: 207-546
ttttcctgaatggttctgtcgtcctggggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggt

SEQ ID NO: 127855 - DNA, 1060 bp, Homo sapiens
  Payload ID: 5026
  Gene Symbol: DOK4
  Gene Name: docking protein 4
  ENST ID: ENST00000569010
  CDS Start-End: 323-1060
ctgtggggcaggtgggcagtgagggccctgggagtctccctactccccgccaccccaggacaccagcccttcctggggagaggagcattttggagctggctctccctgcgcggaaacctgtggtggcctggcaccaggcagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgagg

SEQ ID NO: 127856 - DNA, 580 bp, Homo sapiens
  Payload ID: 5026
  Gene Symbol: DOK4
  Gene Name: docking protein 4
  ENST ID: ENST00000564378
  CDS Start-End: 233-580
gactgggctggaccattttcctcactgccgcctccacctcggttttcctgaatggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctc

SEQ ID NO: 127857 - DNA, 1963 bp, Homo sapiens
  Payload ID: 5027
  Gene Symbol: DOK5
  Gene Name: docking protein 5
  Uniprot ID: Q9P104
  ENST ID: ENST00000262593
  CDS Start-End: 351-1271
ttctcctccttctcggccgggaggaggcagggctggatccctcagccgccgccgctcctcctcctggcaggccggccgcggagtcagctgacgccggcgctccagcctcgcctccccgcgccgcgctctgcgctccccgaaagtggctgcaagccggccgcccactgtcagggttggggggacagagaaagtgatgtgcgccttctaaagcctcgcccagcgccgccgaagcagcttcacctctccaactttctcccaccgactgcttgtcttgaccctgccctccaccctccccagagccacttcgggtgcgcgctcttgggtaaagggggggtcaccggctgtctgggatggcttccaattttaatgacatagtgaagcaagggtacgtgaggatccggagcagacgcctcgggatttatcagcgatgctggttagtattcaagaaagcttcaagcaaaggtccaaaaagactggagaaattttctgatgaacgtgctgcatatttcaggtgttatcataaggttacagaactcaataatgtgaagaacgtagctcgattgccaaaaagcaccaagaaacatgccatagggatttatttcaatgacgatacctccaagacttttgcttgcgaatcagatcttgaggctgatgagtggtgcaaagtactccagatggagtgtgtaggaacacggatcaatgacatcagccttggagagcctgacttactggccactggggttgagagagaacagagtgagagattcaatgtgtatttgatgccatctcctaacttagatgtacatggcgaatgtgccttgcagattacatatgagtatatctgtctttgggacgtccagaatcccagagtcaaactcatctcttggccgctaagcgccctgcggcggtatggacgtgatactacgtggttcacttttgaggcagggaggatgtgtgagactggtgaagggctgtttatctttcagacccgagacggggaggccatctatcagaaagtccactctgctgccttggccatagccgagcagcacgagcgcttgctacagagtgtgaaaaactcgatgctccagatgaagatgagtgagcgggccgcctcgctgagcaccatggtgcccctgcctcgcagcgcctactggcagcacatcacacggcagcacagcacgggacagctctaccgcttgcaagatgtttccagccctctgaagcttcatcgaacagagacttttccagcctacagatctgagcactgacagtaactgccaagaattgttaacacacttgtgatgtgtcagccacagattcacccaggaggtcacagaatgacagcaagggaaatgacgaccaagagaagaagcttaaagtcctggctaattgtgtggtcattggaaaactctgcaatacaataattttctttattttctttttcttttttaaattcttagtgtaattgaaacgtgctctatagatattgactctgtgttccctcttttacagctggacagaaagaagtcaatgtcacgaaatgattttctattgtagatactttgtcccttgcacttctctgaatctgtccttttgtggattcttgtgattttccttccaagtgtttcagttgtatgacagtcagtattgacaataaaatggcttttaattatttgttatttgtttacaccctattcctcagttattattactgtggttctgattaactactggaaattatatttgattatatcaccaattagttaaatcagtgcttcgactcactcttatctgttctgttcaaaactatttgttcaaagaacccgttagtgttgtttacagggttacagtttctctcacatgctttcctcacccctttacccccctttttgaaagcctttattttgttcggagtctcttcataaaacatttgaaaataaaagatcattcttcacccata

SEQ ID NO: 127858 - DNA, 1453 bp, Homo sapiens
  Payload ID: 5027
  Gene Symbol: DOK5
  Gene Name: docking protein 5
  Uniprot ID: Q9P104
  ENST ID: ENST00000395939
  CDS Start-End: 446-1042
cgcgctctgcgctccccgaaagtggctgcaagccggccgcccactgtcagggttggggggacagagaaagtgatgtgcgccttctaaagcctcgcccagcgccgccgaagcagcttcacctctccaactttctcccaccgactgcttgtcttgaccctgccctccaccctccccagagccacttcggatttatcagcgatgctggttagtattcaagaaagcttcaagcaaaggtccaaaaagactggagaaattttctgatgaacgtgctgcatatttcaggtgttatcataaggttacagaactcaataatgtgaagaacgtagctcgattgccaaaaagcaccaagaaacatgccatagggatttatttcaatgacgatacctccaagacttttgcttgcgaatcagatcttgaggctgatgagtggtgcaaagtactccagatggagtgtgtaggaacacggatcaatgacatcagccttggagagcctgacttactggccactggggttgagagagaacagagtgagagattcaatgtgtatttgatgccatctcctaacttagatgtacatggcgaatgtgccttgcagattacatatgagtatatctgtctttgggacgtccagaatcccagagtcaaactcatctcttggccgctaagcgccctgcggcggtatggacgtgatactacgtggttcacttttgaggcagggaggatgtgtgagactggtgaagggctgtttatctttcagacccgagacggggaggccatctatcagaaagtccactctgctgccttggccatagccgagcagcacgagcgcttgctacagagtgtgaaaaactcgatgctccagatgaagatgagtgagcgggccgcctcgctgagcaccatggtgcccctgcctcgcagcgcctactggcagcacatcacacggcagcacagcacgggacagctctaccgcttgcaagatgtttccagccctctgaagcttcatcgaacagagacttttccagcctacagatctgagcactgacagtaactgccaagaattgttaacacacttgtgatgtgtcagccacagattcacccaggaggtcacagaatgacagcaagggaaatgacgaccaagagaagaagcttaaagtcctggctaattgtgtggtcattggaaaactctgcaatacaataattttctttattttctttttcttttttaaattcttagtgtaattgaaacgtgctctatagatattgactctgtgttccctcttttacagctggacagaaagaagtcaatgtcacgaaatgattttctattgtagatactttgtcccttgcacttctctgaatctgtccttttgtggattcttgtgattttccttccaagtgtttcagttgtatgacagtcagtattgacaataaaatggcttttaattatttgtta

SEQ ID NO: 127859 - DNA, 8890 bp, Homo sapiens
  Payload ID: 5028
  Gene Symbol: DOK6
  Gene Name: docking protein 6
  Uniprot ID: Q6PKX4
  ENST ID: ENST00000382713
  CDS Start-End: 191-1186
gttccccgtccgcggcggccctgcaggcgaccccgcgtccccaccggcgggagctcggggaagagcgggcggcggcgctgctgctggcggcggccggctggatgcgagacccgcgcagacccggcggcggacggcggctctcgactccggagagcggatcgcggggcgcaggagcccgatcgcgctggccatggcctccaactttaacgacatagtcaagcagggctacgtgaaaatccgcagcaggaagcttgggattttcagacgatgctggttggttttcaagaaggcttctagcaaaggacccagaaggttagaaaaatttccagatgaaaaggcagcttatttcagaaactttcataaggtaactgaactgcacaatatcaaaaatataaccagactgccccgagagacaaagaagcatgcggtggcaatcatctttcacgatgaaacatcgaagacatttgcctgtgagtcagagctggaggccgaggagtggtgcaagcacctctgcatggagtgtctggggaccaggctcaatgatatcagccttggggagcccgaccttctggccgcaggagtgcagcgggaacagaatgagagattcaacgtgtatcttatgcctacaccaaacctggatatttatggtgaatgcacaatgcagatcactcatgaaaatatctatctctgggatatccacaatgccaaggtcaaactggtgatgtggcctctcagctcactgaggagatacggtcgggactcaacgtggttcacgtttgagtcaggaagaatgtgtgacacaggagaaggactattcacttttcaaacaagggaaggagaaatgatctatcagaaggttcattctgcgacactggccatagctgagcaacatgaaagattaatgctagaaatggaacagaaggcccggcttcagacaagcttgactgaaccaatgacattatccaaatcaatatctcttcctcgcagcgcgtactggcatcacatcactcgtcagaacagcgttggtgaaatctacagtttgcaaggtcatgggtttggttcgtcaaagatgtctcgtgcacagacatttcccagctacgccccagaacagagtgaagaggcccagcagccgttgtcgcggtccagcagctatggattcagctacagctccagcctcatccaatgacacacagagagccgctgttgactagagagacagtctgtcctggacccgtctgtggggtcattaccctctgcctcctggaagaccaattgcagtacaaattgaaatgggtcggctctagccccagtcccattggaaggttaaaaactggagttctgcttccttgattcagtggctaagtcctttatttattgaatttctttgggggaatctatgttttacataaatagaatccaaatcgtatgaacagttatttaaataaacaaaattctttgggtctgacagtaacagaaacctcagcactgggaaaagttgcccacactggggtatgcctgggtgatgggcacctctcactgacctcacagcgcagtccgcccatctgagcacagggtctgtccttagacataatggtgaccctccacaagctctgtggcttttaaagttctgacagggataaatacagtaagctctgcaaatgacatcgtagctgcatataaataaacccagtgacaattaaaggaacatgaaattcagaacacactattaagcagggccctgtagctctactcgtgtgtgtgtgtgcgtgtgtgtgtgtgtgtgtagacaaatggatattgctatatccatctatatataacaagtatatatcaaacatgtgctgagggtgacaggatatgctcacttaaattgttgaaaaccataatttggtgcattaaagttaagattgttatgttgaatagctatttttaaaatagtgctgtaaaaaaaaaaaaaaaaaaggcttcttattagcaaaagtatatgtaatccagtctgttcctaacaagtgtaagcaaaaatgtgagaaggggaacattcagaagcaaaagaaccagtctagctgtcctacacatcatgtcataccctgtctttctggtgagcgtttccttgttgctgacaatgttgctccctgtggccatccatctgagctacgtgaggaggattccatgtgaacgccgatcagcttccatttaaccttgagagaaaagagaggttctaaatgaagaactctttaagaaagaaagaatacacccataaagaactcagctattttgcagtaaagagaagaacaaaatgggtacaggattgtggatatcatagatgctgttctcacacaaccactgggggcttgtaatttactgtgtaaccagaacttgcagggctttattttttcttttactggacacaggttgtctgagattataagaaataaaatagatcaataattttcatcatccctgacactgattacaaacctacagtgtttaaagggaggtagtgaattccacggaaactgagtttggctaattcaggtcaacaaagatatatttgcccttaattctggagttaagtaaaaataaaaattatcctgcctgaatcatctgatgctttgtgcctaagatggttatctctcaaatactctagggtgggtttaaagaacagtgagctcaggtcacgcaagatgaaaacccaggttttttttttcttaataggaaaattttttaaactatccaaattagtctgttgaaagggtaccttttttgctgatctctgatgagttgtcttttcatccctatctgtagcttgagtgcagattgacaattcatttcagtgaattactaccgaataaaagtggttccggatccctcctagataaatgtgcacttacagcaactacctaggctctccaaatcactccactcggtatgaaaaccccatcaagatactaatcgtaagagttaatgtggctgcaaaaaataattatcctaagctttcagggataaaaagaaaattacccaggttctctgcactgtgaattttgctgacacagcggaggagcagatgactggttcctacaactgtacagccttccttgaaatcatagcttttggggttaaacacttgtgaatttcttttgcacatggcatttgcttttgaaatgcctttagtcaaatacaccagagcaactcccagctgagaccatttgagcacagttcctagtggggccacattcagagcaagcctctcgccggctcactcagttgagctgttgcttagacaccacaagtttctacaagggacttatggggaacggccctcaggggtcctggttcacatctcagctttattcatgtgctggaagcacaaacagcgagtccagggagggattctgctaatcagatgagtctgctcttgtgtctctttcttaggagacaaatacctgtatgtaattgcttcaagaactccatttggttctgatcattaccaatgaatataactgaaggagcaccaaagatcaggcataacctcgggccagttcattctgaaaatgatgtcgtaaaaagagtatgtgtgagagaaatctccttcccaagtttttaaccagatctcgtcacaatgaggagaatgctataatctatctcatggtacatttttggagcttaattctagcatactcctccaagtacactcacaattgtagctgagtcaagactgctaaatgaacagataggagaacttatattagactaatatccttgacacgaagcagggttcattgtaataaaaacggcaaacagataaatcttctaccaaaaccaaagatggaaagtcactgcaccagtctcctggaacttcataaaatcaatttcactggagcaaccagaagggtcatggagatgtataccactcgcttgggctcgtaggtttttgactggggatgcctctacactttgtaagtcatttctcccttcaaaaattgtattatatctttaatatatgtgtatttttcaatgcgagggaggaattactatgaaccaaagatatcttttggctccttctgaaagtgactcagtttgaattccattcagatttgtacagataaatagatggtcaccatttctgcatcaggttggaagagaccaatgataaaggaacccaacgtaaggaatagcagttctgaaaatagacaaagcctagaggaggtatctatttcactgagagattacacgaggggacttattttttatgttcccaattttttcttctgataatattaatcaatgtacacatgattgatgcatgatattacacttaaaatgcaggagagtacaaaacaaccttgatccaatagtttcctattctggggggtgggggcagaggcggaaaagaaaacacatctttcacttacttattgaacaaacaataagcactcagaactaatttatttatgcaggttgcaaatatgtatgaagcaataggttctggccactgccacaatttgaaatcaataaaataagaaatatatatttatatatgagggaagatgctgtttgatagagcatgtgaaatcaatggaaacatatttattaaaagtaaacctcacctttttcaccaaatagtaactagagaactagtcctagtatcttgcgtaattcttctctgtcttcattgggaaattatgtttgaaaatctttcatcacctataaaatggtgagcctcttgtactttctattcagtgtagaaagagtggactgataaataactttacattgttggtagtagtttctacagatccagtttattgcatgtcgtatctttattgtagatattaaaaacacatgataaaaattgatgtgtgcccctccttgtttggccagtatcacagaaaactttgtaaaaaagcatggggaccctactccctagattatttgagccatttactaaaattggccattagtgatacagtgaaaacaagctaaggaaatgatattctcctaaaaagttatattccagttttgattattataacacagcacaataaatgggcagtatacgtctaatggaactgagatttaaggctttaacaattcgtgttttaaaatattatattgaagactgcacaaagagaaaattatacatgtttctccaatcctgtgatcatgtctgtaaataccttgcaatttcaaattacttcatccgtcattaactatatgatctcccaaacacagccttctcaaaatcgataaaaatttgccactgaatatgcattaatagctataacaatgggtgacatgccacacaaatttagcttatgcaatttatggggtgtgtgtttgcagactatgaaatgtatgaagtgcagtctcccatggagagaatagagaggcaggatggcaactagtcatgaacgcaacaatttaggttaaatgataaagaatacaatgaaatgtccagagtaacacttggtctctacctttctaacattctaacccaaggccagtgtcatgggcttggctttcttccctgtcgcctcatactgagtatgcaatttacagaggacatctgttgctttatgtcttaaggccactagaggaagtcactacattcccaacaaagatgtgtctttcggcttagtgaaaaacatttaacaagaaacaatgtgtaaccaagtccccacagtaaaatgtgtcttcagaaacatgagaatcacttttatatagccaacctcatttgaattttatcatgaacataaattatcggtgagactggtgtgcggggctggatctgtgagacaagctcacactctcatgtgtgcattctctattaacatatttggaagattgcccacattttctctgcagacctgccacaaatccttaccttcttactgaagaatgtgactattgtagcattcgtgcaattatgccagcagaggaggcactagacagtttatagactcttatggaagttgggcacatttcccaggcaggtggaatgctagctagatctagaagcacccttaaaggtcatgtagaatcaaggtcccactttatgtttcccttgggagaaaactgaaacccatggatgctgtaatttgtttaacggcaaagaaagagccaagaattgtttctcgtagttccagggtcctgatctaggaatgtttccttggctccatggcatctcccagtttgacatagtgggagctgagaaatgccatatggcctcaaaataaataaacccttgtacatttaagtgttttcccagattttcagatgcctctactcttgctgaactcatcaccagctgtatcagtagagaggtgttatggggcaattcattagatttctggtaggtcatgaatggttggtataagctttatttactcatatattgtcatccagttctttgaaattcaatcttatcctaaagtggtagtcaaagtaaaacacattaagtaggtgtttgtgtttagcagtcctactaattcatcacaatcacatagtaattgtgattataatttttggaatctttatcactttctagcactttacggtgtcattatttatggcatttttaacaactttgttgcataattgataacatcagggctacatttttttcatgtgagcctcaagaagcttccattatcaacaagaattggggaaatgacttttttacattataataccttatatattaggtttttcctgataatcttcagtagacaatgatttaaattaactgaagtttaaataagaaatatgttaaaattactaaataatatgaaaaccacattatacttgtaattttcagacacttttctcctaccttaagattttaacatcttgtaaatattaatatttgaaggggagaggaaaaatacatttgtagtagaaatattccctctaacaattctgtttaactagtaagttttttttaagttatcttccatgcctgcttccctagtctgaactccacattccagttgtcagaagaatgaatggatttaaattttctaatcattattttgggcccatgttagcagttgaaacaattaagttcctcactctttcctgcttttaggatgattttagactgtgagcataaaatcaaccctttctgtcagcacagaattgaacatcgaatggagcaaggtctacactctcagcctgtagctgtgctaatgttaggattgaattgttctattaattccctcaagagacccacagcctcaaaagagttgcttattatcagatgtccgaaattcagaaacccaaagtcaggcaaagaaggaaactgagataatgatttaatttttttaagtcactgcaggatttctctcaaagaaaacatctgaaaatggttgagaaagtagttccagatcattaactattttacagagggactgaaagccagggaaaataaagaacagaatgatagtagtatcttgatattaaatttgcatcagaaatgagcaaaatatgtcaatatgaaataatttgaaatcaaattcagattcacatgtatagtgcatagttcaagaaataatgcttactcttgtaaaaaaaaaaaatatatatatatgtatcagcaggtagagtgtgggagctccaactttgttgtgaaagctgataacagagtatgattctttccagttacaaaatactgtattactttagttatagcaagcagtacataaatgacatcaacaactcaggctgctccctgacataaaagccagttccatctttactgcagatgacaggagactttccaagacctgcagaggccccctccaccccaaccttagtgcatgctcacacacacacacacacacacacacacacacacacacacacacatttttggcttttgacccactctgtgtgttccactgaagttatcttttccttaatagattcacacagaattaccccatcctgcaaaatccttatccctatgaatctctaaaatatattaaataatgtgttatatatttgctttttgtaaatctttatttaattaatttatatatactttgtgaagtcttatactgtacatcataaagcgatgtcatctgtagttggttcaatataatgtttatgatcattttgataagaaataactttggacattaggcccttgttaagaaataaaacacccattataaatttgcttctgttggaaaatacatgatttggcatacttcatttttagtaacaatctattctagataaatgataatttggggacatctgtacttaaaaactagctgaactacgttttgggatgagatgcaaagcaacagctgtccctggaactgaaatgtgaatttctagcagaacagaaaatattataataatgaggcaataataaaattaggaaattaaattatttttaaatctgtctgtgtgatttttccccttggtaaaaatacatgaaatacataattgaaaaattaccttcttctgaagtcgtagtttttaatcttaaccatcaataaataaacctattgttaacaatgtcttattcataattctaaaaaatttacaaatgatattgctatgaggttgtgcactattaaagtttgctccatcacttaaaggtaaagcagttcaaaaatactactttacatcacaactttgcatggctgagattttgaacaactaaattgatggttttacccacaagttatttcataaagctaacactgtaatattacttggttttcttatacttttgttatcatgtgatgaaatgtaactatgtaattaaacaaaattctgacaatcatattctgctaatgtttaaaatgttacttattccttcacttattagcttgctattttgaaaataaagtgaaagaaggccctttattaaatgaaa

SEQ ID NO: 127860 - DNA, 506 bp, Homo sapiens
  Payload ID: 5028
  Gene Symbol: DOK6
  Gene Name: docking protein 6
  ENST ID: ENST00000582992
  CDS Start-End: 1-470
agctggaggccgaggagtggtgcaagcacctctgcatggagtgtctggggaccaggctcaatgatatcagccttggggagcccgaccttctggccgcaggagtgcagcgggaacagaatgagagattcaacgtgtatcttatgcctacaccaaacctggatatttatggtgaatgcacaatgcagatcactcatgaaaatatctatctctgggatatccacaatgccaaggtcaaactggtgatgtggcctctcagctcactgaggagatacggtcgggactcaacgtggttcacgtttgagtcaggaagaatgtgtgacacaggagaaggactattcacttttcaaacaagggaaggagaaatgatctatcagaaggttcattctgcgacactggccatagctgagcaacatgaaagattaatgctagaaatggaacagaaggcccgggtaaggccccttccttggtaacctatcagcttggaaatgaatgtcactgggatctga

SEQ ID NO: 127861 - DNA, 2562 bp, Homo sapiens
  Payload ID: 5029
  Gene Symbol: DOK7
  Gene Name: docking protein 7
  Uniprot ID: Q18PE1
  ENST ID: ENST00000340083
  CDS Start-End: 66-1580
attttgaaagtgaccctgggctggggcgccggggcgagcgcggcggcgcggaaccatgacagaagatgaccgaggcggcgctggtggagggccaggtcaagctgcgggacggcaagaagtggaagagtaggtggctggtgctgcggaagccgtcgcccgtggcagactgcctgctgatgctggtctacaaggacaagtcggagcgtatcaagggcctgcgggagcgcagcagcctgacgctagaggacatctgcgggctggagcccggcctgccctacgagggcctggtccacacgctggccattgtctgcctgtcccaggccatcatgctgggctttgacagccacgaggccatgtgtgcgtgggatgcccggatccgctatgcgctcggcgaggtgcataggttccatgtgacagtggctccaggcaccaagttggagagcggcccggctaccctgcacctctgcaatgatgtcctcgtcttggccagggacatccccccggctgtcacggggcagtggaagctgtctgacctccggcgctacggggccgtgccaagcggattcatctttgaaggcgggaccaggtgtgggtactgggctggcgtcttcttcctgtcctcggccgagggggagcagatcagcttcctgttcgactgcatcgtccgaggcatctcccccaccaagggcccctttgggctgcggccggttctaccagacccaagtcccccgggaccctcgactgtggaggagcgtgtggcccaggaagccctggaaaccctacagctggagaagcggctgagcctcctctcacatgcgggcaggccgggcagtggaggggatgaccgcagcctgtccagctcatcctcagaggccagtcacttggacgtcagcgccagcagccggctcaccgcatggccagagcaatcctcgtcgtcagccagcacgtcacaggaggggcctagaccagcagctgcccaggccgccggggaagccatggtgggtgcctcaaggccaccccccaagccgctgcgtccgcggcagctgcaggaggttggccgccagagctcctcggacagcggcatcgccactggcagccactcctcttactccagcagcctctcgtcctacgcgggcagcagcctggacgtgtggcgggccacagatgaactgggctcactgctcagcctgccagcagcgggggcccccgagcccagcctgtgcacctgcctgcccgggacagtcgagtaccaggtgcccacctccctgcgggcccactatgacacaccacgcagcctttgcctggctcctagagaccacagccccccctcacagggcagccccggcaacagtgcggccagggactcaggcggccagacgtccgccgggtgtccctctggctggctgggcacgagacggcggggcctggtgatggaggccccccagggcagcgaggccacactgcctggccctgcccctggcgagccctgggaagcaggcggcccccacgcggggccacccccggctttcttttcggcatgtccagtctgtggaggactcaaggtaaacccccctccttgagagccgcagatcccgccccgcggctgcaaaggggctgaatttgcccccagatggcagaggaagtggcgccagcctccttgcagactggtgctctgtgttctgtgggagggaccgggggtctcccggagaggggagctggagggcgcgccctgtggctgccaccggaggaaggggctgacttggggaggtgagttctggaaggcaggggctctgggtccggcaggtcggggtcaccagagccccaatgctcagctgcttcactccgtgtcccccacccctgaggatcaggtgagtgctgcacctctgttggctcgtgccttgcactggggtgccaagggctggaggccctgccgctggccttgtcctccttgggcctcacgcccccttcgggggtggccggttctccccatcacctctctggggcagtcacaccacctgttaagcatcaagctaccacagaggctccggccacctgggctccaccagcccagcccccctgggctccgtgtgcgctgggcctcatccccatctatgggaggaaactgaagctcaggaggctgtgtggcttgcggggtctctgggttctgggccccactgttccccagtgaagcccttgtgggaaggttccgggagcaggtggtgtcctcagagcagcctcgcctgctgaccccactgggagaggcgccgtgcctcgggcccctggtgggagctctgctggctcctgtctgaacctcctcgcagggccaaaggctggcttggcctgtgtttcccctggcccaggcctcagcccctgcgtcggaggtggggctgtgttgggcccattgtcccccgccctgggtggcttcctcttgcacagcctggagcctgccctgaccacagcccagcagctccctgtgaacacctctttgtcccttcactgtcagctgtttctaaacccagacactgtttgtaatagactggaaataaaatgttctttccttac

SEQ ID NO: 127862 - DNA, 2551 bp, Homo sapiens
  Payload ID: 5029
  Gene Symbol: DOK7
  Gene Name: docking protein 7
  Uniprot ID: Q18PE1
  ENST ID: ENST00000507039
  CDS Start-End: 66-833
attttgaaagtgaccctgggctggggcgccggggcgagcgcggcggcgcggaaccatgacagaagatgaccgaggcggcgctggtggagggccaggtcaagctgcgggacggcaagaagtggaagagtaggtggctggtgctgcggaagccgtcgcccgtggcagactgcctgctgatgctggtctacaaggacaagtcggagcgtatcaagggcctgcgggagcgcagcagcctgacgctagaggacatctgcgggctggagcccggcctgccctacgagggcctggtccacacgctggccattgtctgcctgtcccaggccatcatgctgggctttgacagccacgaggccatgtgtgcgtgggatgcccggatccgctatgcgctcggcgaggtgcataggttccatgtgacagtggctccaggcaccaagttggagagcggcccggctaccctgcacctctgcaatgatgtcctcgtcttggccagggacatccccccggctgtcacggggcagtggaagctgtctgacctccggcgctacggggccgtgccaagcggattcatctttgaaggcgggaccaggggctggcgtcttcttcctgtcctcggccgagggggagcagatcagcttcctgttcgactgcatcgtccgaggcatctcccccaccaagggcccctttgggctgcggccggttctaccagacccaagtcccccgggaccctcgactgtggaggagcgtgtggcccaggaagccctggaaaccctacagctggagaagcggctgagcctcctctcacatgcgggcaggccgggcagtggaggggatgaccgcagcctgtccagctcatcctcagaggccagtcacttggacgtcagcgccagcagccggctcaccgcatggccagagcaatcctcgtcgtcagccagcacgtcacaggaggggcctagaccagcagctgcccaggccgccggggaagccatggtgggtgcctcaaggccaccccccaagccgctgcgtccgcggcagctgcaggaggttggccgccagagctcctcggacagcggcatcgccactggcagccactcctcttactccagcagcctctcgtcctacgcgggcagcagcctggacgtgtggcgggccacagatgaactgggctcactgctcagcctgccagcagcgggggcccccgagcccagcctgtgcacctgcctgcccgggacagtcgagtaccaggtgcccacctccctgcgggcccactatgacacaccacgcagcctttgcctggctcctagagaccacagccccccctcacagggcagccccggcaacagtgcggccagggactcaggcggccagacgtccgccgggtgtccctctggctggctgggcacgagacggcggggcctggtgatggaggccccccagggcagcgaggccacactgcctggccctgcccctggcgagccctgggaagcaggcggcccccacgcggggccacccccggctttcttttcggcatgtccagtctgtggaggactcaaggtaaacccccctccttgagagccgcagatcccgccccgcggctgcaaaggggctgaatttgcccccagatggcagaggaagtggcgccagcctccttgcagactggtgctctgtgttctgtgggagggaccgggggtctcccggagaggggagctggagggcgcgccctgtggctgccaccggaggaaggggctgacttggggaggtgagttctggaaggcaggggctctgggtccggcaggtcggggtcaccagagccccaatgctcagctgcttcactccgtgtcccccacccctgaggatcaggtgagtgctgcacctctgttggctcgtgccttgcactggggtgccaagggctggaggccctgccgctggccttgtcctccttgggcctcacgcccccttcgggggtggccggttctccccatcacctctctggggcagtcacaccacctgttaagcatcaagctaccacagaggctccggccacctgggctccaccagcccagcccccctgggctccgtgtgcgctgggcctcatccccatctatgggaggaaactgaagctcaggaggctgtgtggcttgcggggtctctgggttctgggccccactgttccccagtgaagcccttgtgggaaggttccgggagcaggtggtgtcctcagagcagcctcgcctgctgaccccactgggagaggcgccgtgcctcgggcccctggtgggagctctgctggctcctgtctgaacctcctcgcagggccaaaggctggcttggcctgtgtttcccctggcccaggcctcagcccctgcgtcggaggtggggctgtgttgggcccattgtcccccgccctgggtggcttcctcttgcacagcctggagcctgccctgaccacagcccagcagctccctgtgaacacctctttgtcccttcactgtcagctgtttctaaacccagacactgtttgtaatagactggaaataaaatgttctttccttac

SEQ ID NO: 127863 - DNA, 2090 bp, Homo sapiens
  Payload ID: 5030
  Gene Symbol: DOLK
  Gene Name: dolichol kinase
  Uniprot ID: Q9UPQ8
  ENST ID: ENST00000372586
  CDS Start-End: 317-1933
gttgccgcggggcggtgccaagatggcgaggcccaaagaggtgaggagccggcagcgggggcggctgtaactgtgaggaaggctgcagagtggcgacgtctacgccgtaggttggaggctgtggggggtggccgggcgccagctcccaggccgcagaagtgacctgcggtggagttccctcctcgctgctggagaacggagggagaaggttgctggccgggtgaaagtgcctccctctgcttgacggggctgaggggcccgaagtctagggcgtccgtagtcgccccggcctccgtgaagccccaggtctagagatatgacccgagagtgcccatctccggccccggggcctggggctccgctgagtggatcggtgctggcagaggcggcagtagtgtttgcagtggtgctgagcatccacgcaaccgtatgggaccgatactcgtggtgcgccgtggccctcgcagtgcaggccttctacgtccaatacaagtgggaccggctgctacagcagggaagcgccgtcttccagttccgaatgtccgcaaacagtggcctattgcccgcctccatggtcatgcctttgcttggactagtcatgaaggagcggtgccagactgctgggaacccgttctttgagcgttttggcattgtggtggcagccactggcatggcagtggccctcttctcatcagtgttggcgctcggcatcactcgcccagtgccaaccaacacttgtgtcatcttgggcttggctggaggtgttatcatttatatcatgaagcactcgttgagcgtgggggaggtgatcgaagtcctggaagtccttctgatcttcgtttatctcaacatgatcctgctgtacctgctgccccgctgcttcacccctggtgaggcactgctggtattgggtggcattagctttgtcctcaaccagctcatcaagcgctctctgacactggtggaaagtcagggggacccagtggacttcttcctgctggtggtggtagtagggatggtactcatgggcattttcttcagcactctgtttgtcttcatggactcaggcacctgggcctcctccatcttcttccacctcatgacctgtgtgctgagccttggtgtggtcctaccctggctgcaccggctcatccgcaggaatcccctgctctggcttcttcagtttctcttccagacagacacccgcatctacctcctagcctattggtctctgctggccaccttggcctgcctggtggtgctgtaccagaatgccaagcggtcatcttccgagtccaagaagcaccaggcccccaccatcgcccgaaagtatttccacctcattgtggtagccacctacatcccaggtatcatctttgaccggccactgctctatgtagccgccactgtatgcctggcggtcttcatcttcctggagtatgtgcgctacttccgcatcaagcctttgggtcacactctacggagcttcctgtccctttttctggatgaacgagacagtggaccactcattctgacacacatctacctgctcctgggcatgtctcttcccatctggctgatccccagaccctgcacacagaagggtagcctgggaggagccagggccctcgtcccctatgccggtgtcctggctgtgggtgtgggtgatactgtggcctccatcttcggtagcaccatgggggagatccgctggcctggaaccaaaaagacttttgaggggaccatgacatctatatttgcgcagatcatttctgtagctctgatcttaatctttgacagtggagtggacctaaactacagttatgcttggattttggggtccatcagcactgtgtccctcctggaagcatacactacacagatagacaatctccttctgcctctctacctcctgatattgctgatggcctagctgttacagtgcagcagcagtgacggaggaaacagacatggggagggtgaacagtccccacagcagacagctacttgggcatgaagagccaaggtgtgaaaagcagatttgatttttcagttgattcagatttaaaataaaaagcaaagctctccta

SEQ ID NO: 127864 - DNA, 1932 bp, Homo sapiens
  Payload ID: 5031
  Gene Symbol: DOLPP1
  Gene Name: dolichyldiphosphatase 1
  ENST ID: ENST00000327812
  CDS Start-End: 1-274
ggcagcggacggacagtgctcgctccccgcttcatggcggccggtgaccctcacccacgtcgaatatcctgcaggtgatctctctggccacctccttgcctacctgagcctcagccctgtatttgtcatcgtcggtttcgtgaccctcatcatatttaagcgggagctgcacacggcccccacacagcagtgggcaccaagtacgggatgccctccagccattcccagtttatgtggttcttctccgtctattccttccttttcctgtatttaagaatgcaccaaacaaacaacgccaggttcctggacttgctgtggaggcacgtgctctccctgggactcctcgctgtggccttcctagtctcctacagcaggcctgtctccgagttcttcctaatccgagacacaagcctcattcccaacgtactctggtttgagtacacggtaacccgggcagaagccaggaacagacaacgcaagctggggacgaaactgcagtgaccagtgggtgtggctgggtccagcctccagatctggcccgcacgatgccttgcaggatggacaggatgacagacagggacgaagcagagacctctacagacccaagtcaccaagtggagcctttttttttcttattttaattttaatgaacaaggtggaccaaagggctgaaccagcccctcaaccaggaccctggggggcctgctgcctgggggccgtggccagagaccctcgctgtgctgctgccagcccctggctgggcagaaagtgccctcggcatgggcacctgggtgtggggtggaggaggagggctcgcgcctctggtctcggggccaggaattccaggtggcgtgagaagtacacactatttattttttggttttgtcagaggcaggcaggattttggagctggaagaatctgctctccggtggctgccctgtgaacagagggctcccggtcagcttcccaggcccttcgccctatgcccagagggcagactgcctctccctgggccggggtggcctgggtgccaggaggaggggagcataccccacaccctccctgccaccgttgccgttccagaacctcggtcagtgtttccctgtctgggggcagggcccagagcgagcacgcgtctggcggctgctgtcgttgtgttctaccccgtactgacccaacaccacaagggctttctctggtcccctgtccctaagacaataatcgctttctgacaaaggagcctgcacatttgggtgagcagacccaagctgtttacagctctttcttgtcctgccatccagtagcagttagtcttcatccccacgtgaacaaaatgggaaggagccgtgaggagaggagtgaggcaacaggcacccgaagtccctcgtccttccctctgtgtgctctgaatatgtccttgtccttcctgacccatctctgaccagctgggaacctgcttggggtccccctcaaacctgtgtctggggtgtgggctcacagatccctatcagcctggttcgtgggagggctcttcctaaagggacccccatctctaagtcactctgaaagggagttgtggagaggagacgcctccagactctcagaagttttgaggactgaactgggtcactcgggatctgtgttcgaatcctccccacccctttctttgtggagtttcctaacctgctgctgaagcacaatgttttggtgctttcttttctcatttgttaaaggcagtgtccaaaagccattccagatgccaagaccaggggcttatttctagggaaggtaggtcggtttccatgtttccctcccgttatttttattttttactttttgcctgagacaagccgagtatgaggtggtttgatttaagaaaaatcaatgaaattgtttactactgttttaaaataaaaccgtaaactctggca

SEQ ID NO: 127865 - DNA, 2177 bp, Homo sapiens
  Payload ID: 5031
  Gene Symbol: DOLPP1
  Gene Name: dolichyldiphosphatase 1
  Uniprot ID: Q86YN1
  ENST ID: ENST00000372546
  CDS Start-End: 33-749
ggctgctcgaagaagcccggtctccgggtaagatggcagcggacggacagtgctcgctccccgcttcatggcggccggtgaccctcacccacgtcgaatatcctgcaggtgatctctctggccacctccttgcctacctgagcctcagccctgtatttgtcatcgtcggtttcgtgaccctcatcatatttaagcgggagctgcacacgatctccttccttgggggcctggcactgaacgagggggtcaactggctgatcaaaaacgtcatccaggagccacggccctgtggaggcccccacacagcagtgggcaccaagtacgggatgccctccagccattcccagtttatgtggttcttctccgtctattccttccttttcctgtatttaagaatgcaccaaacaaacaacgccaggttcctggacttgctgtggaggcacgtgctctccctgggactcctcgctgtggccttcctagtctcctacagcagggtctacctgctgtaccacacctggagccaggtgctctatggaggcatcgctggaggcctcatggccatcgcctggttcatcttcacccaggaggtcctcaccccgctgttccccaggatagcagcctggcctgtctccgagttcttcctaatccgagacacaagcctcattcccaacgtactctggtttgagtacacggtaacccgggcagaagccaggaacagacaacgcaagctggggacgaaactgcagtgaccagtgggtgtggctgggtccagcctccagatctggcccgcacgatgccttgcaggatggacaggatgacagacagggacgaagcagagacctctacagacccaagtcaccaagtggagcctttttttttcttattttaattttaatgaacaaggtggaccaaagggctgaaccagcccctcaaccaggaccctggggggcctgctgcctgggggccgtggccagagaccctcgctgtgctgctgccagcccctggctgggcagaaagtgccctcggcatgggcacctgggtgtggggtggaggaggagggctcgcgcctctggtctcggggccaggaattccaggtggcgtgagaagtacacactatttattttttggttttgtcagaggcaggcaggattttggagctggaagaatctgctctccggtggctgccctgtgaacagagggctcccggtcagcttcccaggcccttcgccctatgcccagagggcagactgcctctccctgggccggggtggcctgggtgccaggaggaggggagcataccccacaccctccctgccaccgttgccgttccagaacctcggtcagtgtttccctgtctgggggcagggcccagagcgagcacgcgtctggcggctgctgtcgttgtgttctaccccgtactgacccaacaccacaagggctttctctggtcccctgtccctaagacaataatcgctttctgacaaaggagcctgcacatttgggtgagcagacccaagctgtttacagctctttcttgtcctgccatccagtagcagttagtcttcatccccacgtgaacaaaatgggaaggagccgtgaggagaggagtgaggcaacaggcacccgaagtccctcgtccttccctctgtgtgctctgaatatgtccttgtccttcctgacccatctctgaccagctgggaacctgcttggggtccccctcaaacctgtgtctggggtgtgggctcacagatccctatcagcctggttcgtgggagggctcttcctaaagggacccccatctctaagtcactctgaaagggagttgtggagaggagacgcctccagactctcagaagttttgaggactgaactgggtcactcgggatctgtgttcgaatcctccccacccctttctttgtggagtttcctaacctgctgctgaagcacaatgttttggtgctttcttttctcatttgttaaaggcagtgtccaaaagccattccagatgccaagaccaggggcttatttctagggaaggtaggtcggtttccatgtttccctcccgttatttttattttttactttttgcctgagacaagccgagtatgaggtggtttgatttaagaaaaatcaatgaaattgtttactactgttttaaaataaaaccgtaaactctg

SEQ ID NO: 127866 - DNA, 2037 bp, Homo sapiens
  Payload ID: 5031
  Gene Symbol: DOLPP1
  Gene Name: dolichyldiphosphatase 1
  Uniprot ID: Q86YN1
  ENST ID: ENST00000406974
  CDS Start-End: 22-609
gaagcccggtctccgggtaagatggcagcggacggacagtgctcgctccccgcttcatggcggccggtgaccctcacccacgtcgaatatcctgcaggtgatctctctggccacctccttgcctacctgagcctcagccctgtatttgtcatcgtcggtttcgtgaccctcatcatatttaagcgggagctgcacacgatctccttccttgggggcctggcactgaacgagggggtcaactggctgatcaaaaacgtcatccaggagccacggccctgtggaggcccccacacagcagtgggcaccaagtacgggatgccctccagccattcccagtttatgtggttcttctccgtctattccttccttttcctgtatttaagaatgcaccaaacaaacaacgccaggttcctggacttgctgtggaggcacgtgctctccctgggactcctcgctgtggccttcctagtctcctacagcaggcctgtctccgagttcttcctaatccgagacacaagcctcattcccaacgtactctggtttgagtacacggtaacccgggcagaagccaggaacagacaacgcaagctggggacgaaactgcagtgaccagtgggtgtggctgggtccagcctccagatctggcccgcacgatgccttgcaggatggacaggatgacagacagggacgaagcagagacctctacagacccaagtcaccaagtggagcctttttttttcttattttaattttaatgaacaaggtggaccaaagggctgaaccagcccctcaaccaggaccctggggggcctgctgcctgggggccgtggccagagaccctcgctgtgctgctgccagcccctggctgggcagaaagtgccctcggcatgggcacctgggtgtggggtggaggaggagggctcgcgcctctggtctcggggccaggaattccaggtggcgtgagaagtacacactatttattttttggttttgtcagaggcaggcaggattttggagctggaagaatctgctctccggtggctgccctgtgaacagagggctcccggtcagcttcccaggcccttcgccctatgcccagagggcagactgcctctccctgggccggggtggcctgggtgccaggaggaggggagcataccccacaccctccctgccaccgttgccgttccagaacctcggtcagtgtttccctgtctgggggcagggcccagagcgagcacgcgtctggcggctgctgtcgttgtgttctaccccgtactgacccaacaccacaagggctttctctggtcccctgtccctaagacaataatcgctttctgacaaaggagcctgcacatttgggtgagcagacccaagctgtttacagctctttcttgtcctgccatccagtagcagttagtcttcatccccacgtgaacaaaatgggaaggagccgtgaggagaggagtgaggcaacaggcacccgaagtccctcgtccttccctctgtgtgctctgaatatgtccttgtccttcctgacccatctctgaccagctgggaacctgcttggggtccccctcaaacctgtgtctggggtgtgggctcacagatccctatcagcctggttcgtgggagggctcttcctaaagggacccccatctctaagtcactctgaaagggagttgtggagaggagacgcctccagactctcagaagttttgaggactgaactgggtcactcgggatctgtgttcgaatcctccccacccctttctttgtggagtttcctaacctgctgctgaagcacaatgttttggtgctttcttttctcatttgttaaaggcagtgtccaaaagccattccagatgccaagaccaggggcttatttctagggaaggtaggtcggtttccatgtttccctcccgttatttttattttttactttttgcctgagacaagccgagtatgaggtggtttgatttaagaaaaatcaatgaaattgtttactactgttttaaaataaaaccgtaaactctg

SEQ ID NO: 127867 - DNA, 911 bp, Homo sapiens
  Payload ID: 5031
  Gene Symbol: DOLPP1
  Gene Name: dolichyldiphosphatase 1
  ENST ID: ENST00000412363
  CDS Start-End: 1-268
ggacggacagtgctcgctccccgcttcatggcggccggtgaccctcacccacgtcgaatatcctgcaggtgatctctctggccacctccttgcctacctgagcctcagccctgtatttgtcatcgtcggtttcgtgaccctcatcatatttaagcgggagctgcacacggcccccacacagcagtgggcaccaagtacgggatgccctccagccattcccagtttatgtggttcttctccgtctattccttccttttcctgtatttaaggcctgtctccgagttcttcctaatccgagacacaagcctcattcccaacgtactctggtttgagtacacggtaacccgggcagaagccaggaacagacaacgcaagctggggacgaaactgcagtgaccagtgggtgtggctgggtccagcctccagatctggcccgcacgatgccttgcaggatggacaggatgacagacagggacgaagcagagacctctacagacccaagtcaccaagtggagcctttttttttcttattttaattttaatgaacaaggtggaccaaagggctgaaccagcccctcaaccaggaccctggggggcctgctgcctgggggccgtggccagagaccctcgctgtgctgctgccagcccctggctgggcagaaagtgccctcggcatgggcacctgggtgtggggtggaggaggagggctcgcgcctctggtctcggggccaggaattccaggtggcgtgagaagtacacactatttattttttggttttgtcagaggcaggcaggattttggagctggaagaatctgctctccggtggctgccctgtgaacagagggctcccggtcagcttcccaggcccttcgccctatgcccagagggcagactgcctctccctgggcc

SEQ ID NO: 127868 - DNA, 2079 bp, Homo sapiens
  Payload ID: 5032
  Gene Symbol: DDOST
  Gene Name: dolichyl-diphosphooligosaccharide--protein glycosyltransferase subunit (non-catalytic)
  Uniprot ID: P39656
  ENST ID: ENST00000375048
  CDS Start-End: 107-1477
ccgcgccttatcgccaaagctgcggctctggacgcccagccgcggcgtatcccgatcacttccgggtagtgctccacgggcacgagccgcgattgggctaccgtagatggggtacttccggtgtgcacgtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggcggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcaaggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaataaagcgagatgttgccctcaaa

SEQ ID NO: 127869 - DNA, 2126 bp, Homo sapiens
  Payload ID: 5032
  Gene Symbol: DDOST
  Gene Name: dolichyl-diphosphooligosaccharide--protein glycosyltransferase subunit (non-catalytic)
  Uniprot ID: P39656
  ENST ID: ENST00000415136
  CDS Start-End: 144-1514
aatccacctcccaccagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcacgtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggcggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcaaggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaataaagcgagatgttgccctcaaacttcacctgg

SEQ ID NO: 127870 - DNA, 1963 bp, Homo sapiens
  Payload ID: 5032
  Gene Symbol: DDOST
  Gene Name: dolichyl-diphosphooligosaccharide--protein glycosyltransferase subunit (non-catalytic)
  ENST ID: ENST00000602624
  CDS Start-End: 42-1361
tccggtgtgcacgtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggcggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcaaggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaataaagcgagatgttgccctcaaa

SEQ ID NO: 127871 - DNA, 502 bp, Homo sapiens
  Payload ID: 5032
  Gene Symbol: DDOST
  Gene Name: dolichyl-diphosphooligosaccharide--protein glycosyltransferase subunit (non-catalytic)
  ENST ID: ENST00000464364
  CDS Start-End: 39-502
ggtgtgcacgtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaaggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgg

SEQ ID NO: 127872 - DNA, 2205 bp, Homo sapiens
  Payload ID: 5033
  Gene Symbol: DPAGT1
  Gene Name: dolichyl-phosphate (UDP-N-acetylglucosamine) N-acetylglucosaminephosphotransferase 1 (GlcNAc-1-P transferase)
  Uniprot ID: Q9H3H5
  ENST ID: ENST00000354202
  CDS Start-End: 488-1714
attcatcttggaaccgggcaattggcatttccgctctgggtagtacatctttaacataatgttagggaagtatccgttcttggctgcctttctttaattgcgtttccagtactctctcggtgattctactcttgaacataggatgaaatttggaatcacacttctcttccacttccatccccaccctctaatgcccatattaaaaatggcggccgccgccttccgcagtaatggttgttcagcgaacaagatccgggcggaaacagtagataggcgggtgcagcggggcagaacataggttgccttagagaggttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatcccagaatcccagggagtgatcagcggtgctgttttccttatcatcctcttctgcttcatccctttccccttcctgaactgctttgtgaaggagcagtgtaaggcattcccccaccatgaatttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttcttattg

SEQ ID NO: 127873 - DNA, 1817 bp, Homo sapiens
  Payload ID: 5033
  Gene Symbol: DPAGT1
  Gene Name: dolichyl-phosphate (UDP-N-acetylglucosamine) N-acetylglucosaminephosphotransferase 1 (GlcNAc-1-P transferase)
  ENST ID: ENST00000392834
  CDS Start-End: 224-397
agtagataggcgggtgcagcggggcagaacataggttgccttagagaggttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagattttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttctta

SEQ ID NO: 127874 - DNA, 3274 bp, Homo sapiens
  Payload ID: 5033
  Gene Symbol: DPAGT1
  Gene Name: dolichyl-phosphate (UDP-N-acetylglucosamine) N-acetylglucosaminephosphotransferase 1 (GlcNAc-1-P transferase)
  Uniprot ID: Q9H3H5
  ENST ID: ENST00000409993
  CDS Start-End: 1553-2779
gtgcatgggtttggaaccagagtaccttgcccacagaaatggaagtctggggacccagttggatttctacaacctccagccttagcggcacccttttctctgatccgggaggggaagagaagccatagggttccccagtttatgcccaccctcgtctggcctcctagcacgagcagtcagtccctcccctggaaggaaaggctgaagggaccacccaagcgcttggtccaactcaccccgtttctgcaggcctgctcgttcagcgctcgcacccaagcccgctgccagttctcccggaaagacttgaaggcgaagagtgacgccaggaggccccggactcctggctcctcggcggcgccagcccgagtcgcccgcagccgcagcagcgagcgccacacgcccagctcccgcagggaacccgcgggttccccggctaaggcgggtcccgggccccggtccccgcgggcccgcgccagccacaagccccgggcatattgcagcagccaggcgaacaccgtgagcagcgaggcggcgaagaggatcagcaaggccgcccagcccacgtcccgctgcccccagcccggatccatgctccgcgcgggctccgatcccggtcccggctggggctcacccgctgccccgggggagcatggcccgggcgggccgcggggaggaggtgggctcccccggggctgggcgcgcggggtcgggggctctccgcggctgagtgcccaggactagtgggtgccacagggcgaggagaggaggtcctcgggggtcgcgatgccggggtctctgtctccgtggtccgggtctctcctagcttggtcagcagtcggacccgttagtcgccggccagtgcccgactcctcccaccgcgcgggccccgccggaccctggaggggactggtctgcagagacgctggggctcgcgggccggcaccggctccgggagggctgcgtgcgcagagctgacactgacaacaccgccggcgccccgcccccacccgcccttaaaggagccgcacccgcgccgggcggggccaggacagcctggcgctccctcgctggaggagggcgggagggctagcagcgagcggaggaggttccggggttgaaaataggcgggatctttgatcacctcgccccatcttgcaatcgcggtgctcccacactcagctcaaggtttcctgcaagaaacaggcgcgtctccacaccctcgtccctcctccccaccccctgcctttcaatagccatcttcctggagccggaggcatcccagattaagggagaggtacgggccctttaagcttgacctatggaggcggacggagctaaaactgacgtggaaccggaatgtgagcggtgtcagacacgtggtacaaggaggcattcatcttggaaccgggcaattggcatttccgctctggattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatcccagaatcccagggagtgatcagcggtgctgttttccttatcatcctcttctgcttcatccctttccccttcctgaactgctttgtgaaggagcagtgtaaggcattcccccaccatgaatttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttcttattgttta

SEQ ID NO: 127875 - DNA, 1638 bp, Homo sapiens
  Payload ID: 5033
  Gene Symbol: DPAGT1
  Gene Name: dolichyl-phosphate (UDP-N-acetylglucosamine) N-acetylglucosaminephosphotransferase 1 (GlcNAc-1-P transferase)
  ENST ID: ENST00000414373
  CDS Start-End: 206-493
gcggggcagaacataggttgccttagagaggttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatcccagaatcccagggagtgatcagcggtgctgttttccttatcatcctcttctgcttcatccctttccccttcctgaactgctttgtgaaggagcagtgtaaggcattcccccaccatgaagcttgagtcatggacctgcccgagcctcccccagtttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccaca

SEQ ID NO: 127876 - DNA, 999 bp, Homo sapiens
  Payload ID: 5033
  Gene Symbol: DPAGT1
  Gene Name: dolichyl-phosphate (UDP-N-acetylglucosamine) N-acetylglucosaminephosphotransferase 1 (GlcNAc-1-P transferase)
  ENST ID: ENST00000442480
  CDS Start-End: 1-681
gcttccgactatgttggcaacaggtttcctgcaagaaacaggcgcgtctccacaccctcgtccctcctccccaccccctgcctttcaatagccatcttcctggagccggaggcatcccagattaagggagagtttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtgattgtcgggatgatcatgtcttttccctctacttcatgatacccttttttttcaccactttgggattgctctaccacaactggtgttcaacttcctctactcactgcctcagctcctgcatatcatcccctgccctcgccaccgcatacccagactcaatatcaagacaggcaaactggagatgagctattccaagttcaagaccaagagcctctctttcttgggcacctttattttaaaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcagatcctgggcagtgccatcaccttctccattcgatatcagctcgttcgactcttctatgatgtctgagtcccttgatcattgtcctttacctcacagtctctaggat

SEQ ID NO: 127877 - DNA, 1161 bp, Homo sapiens
  Payload ID: 5034
  Gene Symbol: DPM1
  Gene Name: dolichyl-phosphate mannosyltransferase polypeptide 1, catalytic subunit
  ENST ID: ENST00000371582
  CDS Start-End: 33-896
attccgcttccggcatctggctcagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagtgatggagttttgccatgttgcccaggctggtcactcctgggctcaagtgatccagccatcttggcctcctgggattacagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgaggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaagta

SEQ ID NO: 127878 - DNA, 1073 bp, Homo sapiens
  Payload ID: 5034
  Gene Symbol: DPM1
  Gene Name: dolichyl-phosphate mannosyltransferase polypeptide 1, catalytic subunit
  ENST ID: ENST00000371584
  CDS Start-End: 1-886
ggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagtgatggagttttgccatgttgcccaggctggtcactcctgggctcaagtgatccagccatcttggcctcctgggattacaggtgtgagccaccgcgcctagccagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgaggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatga

SEQ ID NO: 127879 - DNA, 1075 bp, Homo sapiens
  Payload ID: 5034
  Gene Symbol: DPM1
  Gene Name: dolichyl-phosphate mannosyltransferase polypeptide 1, catalytic subunit
  Uniprot ID: O60762
  ENST ID: ENST00000371588
  CDS Start-End: 28-810
gcttccggcatctggctcagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgaggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaagta

SEQ ID NO: 127880 - DNA, 672 bp, Homo sapiens
  Payload ID: 5034
  Gene Symbol: DPM1
  Gene Name: dolichyl-phosphate mannosyltransferase polypeptide 1, catalytic subunit
  ENST ID: ENST00000413082
  CDS Start-End: 10-672
agttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattagtgatggagttttgccatgttgcccaggctggtcactcctgggctcaagtgatccagccatcttggcctcctgggattacagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgag

SEQ ID NO: 127881 - DNA, 1542 bp, Homo sapiens
  Payload ID: 5035
  Gene Symbol: DPM2
  Gene Name: dolichyl-phosphate mannosyltransferase polypeptide 2, regulatory subunit
  Uniprot ID: O94777
  ENST ID: ENST00000314392
  CDS Start-End: 665-919
gtcccggtccgaaacgtgtctgggctgctgcgagagacagtcggtgaaggaagggaggggacatccgaagggtggcccgggaggccgggcgatggtgaggagggcgcctcctctccaccaaatcctccccatccatgcgggctagggacagaccctcccccgcccaccctaggctggaaagtgaacgttctctgcacctctcccacctacagactaagtagggcacccggtttccgtgtcggcttcaccactgactcggaatgggatctacctttctctgagcctcacttttcccatctgaaaaatggaacttccgatcccgcactcccatcccactctggccccgggactctgggatacttagagattggcttttggtggggcggcgacaggactgtggccatgaaggccagggagtctgggtccccaactcggtcccattccctagagagattcgggcagcaaccggccccacaatgctcttgagaactacacttcgccgatatgcaaagaagaggaggcggttcctgctcgtctccgacgaggtgggcccgagcaggcctggggactacgactcccggcgtgctccgcagtccaaagccggaagagcgtggacccggaaccggatgtggcttgcggctcgggtggctgagcgcgcggggaaatggccacggggacagaccaggtggtgggactcggcctcgtcgccgttagcctgatcatcttcacctactacaccgcctgggtgattctcttgccattcatcgacagtcagcatgtcatccacaagtatttcctgccccgagcctatgctgtcgccatcccactggctgcaggcctcctgctgctcctgtttgtgggactgttcatctcctatgtgatgctgaagaccaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccagaccccacaaagccttctggacctggaaagcctggggaaggactgacagaccccaggaccagccctggggctcagggcagccaccccgggccgctgaccgactgacctctcctcacggaggcccagccccaaagccccagggctggcccgtttgggacagctgaccaataaacactgatggtgtgtt

SEQ ID NO: 127882 - DNA, 738 bp, Homo sapiens
  Payload ID: 5035
  Gene Symbol: DPM2
  Gene Name: dolichyl-phosphate mannosyltransferase polypeptide 2, regulatory subunit
  ENST ID: ENST00000373110
  CDS Start-End: 24-416
cgggtggctgagcgcgcggggaaatggccacggggacagaccaggtggtgggactcggcctcgtcgccgttagcctgatcatcttcacctactacaccgcctgggtgattctcttgccattcatcgacagtcagcatgtcatccacaagtatttcctgccccgagcctatgctgtcgccatcccactggctgcaggcctcctgctgctcctgtttgtgggtaagtcatcacctcctccccttgaccctgggcagggtttcgggaagaccccacctctgaacatgcttccacactttggcggtgctggaagctgcttgccccgaactcacccgtggggttttcctgttcatccttcgaggctgccagtcagtaacctctgggtttcctggtgccccaggctttttggactccaatgacctgtctacctctttcctgccccaaccccatcatcactctgctcacacctcagtcaccctcttgtcaccctggcttctaattcctgcacctctctctctcatggcttcctagggatggggactgtgtctccatcattactgcacatctagaacaggctgtggcactgaggctgtgctcagaaagtcatttggatgagtcagtcaacagccgggtgcctggatgatgggtggatggatgggtgggtgggtgaggtgtaggaggaggtgggtaggtatgtaggtggacagacaagtggttgaccgggtgatcgatagatgggtg

SEQ ID NO: 127883 - DNA, 486 bp, Homo sapiens
  Payload ID: 5036
  Gene Symbol: DPM3
  Gene Name: dolichyl-phosphate mannosyltransferase polypeptide 3
  Uniprot ID: Q9P2X0
  ENST ID: ENST00000341298
  CDS Start-End: 137-415
gaactacaactcccagaaggccgcgcggaagcggaacgtgaaccagggaggacttccggacgccaacatccgggccgcgcggggaaggggagacgtggggtagaggggagcattgcttccttctctcgcagtgaccatgacgaaattagcgcagtggctttggggactagcgatcctgggctccacctgggtggccctgaccacgggagccttgggcctggagctgcccttgtcctgccaggaagtcctgtggccactgcccgcctacttgctggtgtccgccggctgctatgccctgggcactgtgggctatcgtgtggccacttttcatgactgcgaggacgccgcacgcgagctgcagagccagatacaggaggcccgagccgacttagcccgcagggggctgcgcttctgacagcctaaccccattcctgtgcggacagcccttcctcccatttcccattaaagagccagtttattttctaa

SEQ ID NO: 127884 - DNA, 517 bp, Homo sapiens
  Payload ID: 5036
  Gene Symbol: DPM3
  Gene Name: dolichyl-phosphate mannosyltransferase polypeptide 3
  Uniprot ID: Q9P2X0
  ENST ID: ENST00000368399
  CDS Start-End: 78-446
ggcccttccaccttttgtgggcactcaagttcggacctctgggatcggcgattcccctctggccagggctggttttaatgctctccgtgggcgggcttcggttgagtttggtccgcttttcctttctgctcctcaggggagcattgcttccttctctcgcagtgaccatgacgaaattagcgcagtggctttggggactagcgatcctgggctccacctgggtggccctgaccacgggagccttgggcctggagctgcccttgtcctgccaggaagtcctgtggccactgcccgcctacttgctggtgtccgccggctgctatgccctgggcactgtgggctatcgtgtggccacttttcatgactgcgaggacgccgcacgcgagctgcagagccagatacaggaggcccgagccgacttagcccgcagggggctgcgcttctgacagcctaaccccattcctgtgcggacagcccttcctcccatttcccattaaagagccagtttattttctaa

SEQ ID NO: 127885 - DNA, 409 bp, Homo sapiens
  Payload ID: 5036
  Gene Symbol: DPM3
  Gene Name: dolichyl-phosphate mannosyltransferase polypeptide 3
  Uniprot ID: Q9P2X0
  ENST ID: ENST00000368400
  CDS Start-End: 60-338
acttccggacgccaacatccgggccgcgcggggaaggggagacgtggggtagagtgaccatgacgaaattagcgcagtggctttggggactagcgatcctgggctccacctgggtggccctgaccacgggagccttgggcctggagctgcccttgtcctgccaggaagtcctgtggccactgcccgcctacttgctggtgtccgccggctgctatgccctgggcactgtgggctatcgtgtggccacttttcatgactgcgaggacgccgcacgcgagctgcagagccagatacaggaggcccgagccgacttagcccgcagggggctgcgcttctgacagcctaaccccattcctgtgcggacagcccttcctcccatttcccattaaagagccagtttattttctaa

SEQ ID NO: 127886 - DNA, 1938 bp, Homo sapiens
  Payload ID: 5037
  Gene Symbol: DDC
  Gene Name: dopa decarboxylase (aromatic L-amino acid decarboxylase)
  Uniprot ID: P20711
  ENST ID: ENST00000357936
  CDS Start-End: 70-1512
ggagagagagaggacagagagcaagtcactcccggctgcctttttcacctctgacagagcccagacaccatgaacgcaagtgaattccgaaggagagggaaggagatggtggattacatggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaaatactaa

SEQ ID NO: 127887 - DNA, 1366 bp, Homo sapiens
  Payload ID: 5037
  Gene Symbol: DDC
  Gene Name: dopa decarboxylase (aromatic L-amino acid decarboxylase)
  Uniprot ID: P20711
  ENST ID: ENST00000380984
  CDS Start-End: 64-1080
agagaggacagagagcaagtcactcccggctgcctttttcacctctgacagagcccagacaccatgaacgcaagtgaattccgaaggagagggaaggagatggtggattacatggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtggtccagacaaccagtgcgtatgttaaggctgaagaaaacctgcttagtcagtgcggtggtgagaaggagttgagcctttcgggacgtggagtgcctgccgcagagctgatgccccgaggctgccgcagacgctgcagagctgatgccagcaagttggcggctgtgcgctcatctctcccggacaactcttccccggcgctcggggttcagttcagccaccagcctgtgaggggaaatttgacaaagtggaggtgatgtagggaagagacacaggacacacagggatgaggccaggccatttggaaaaggccatttggaaaatttccttgtagaaggaattaaacgtaagccctaagaca

SEQ ID NO: 127888 - DNA, 1470 bp, Homo sapiens
  Payload ID: 5037
  Gene Symbol: DDC
  Gene Name: dopa decarboxylase (aromatic L-amino acid decarboxylase)
  ENST ID: ENST00000430300
  CDS Start-End: 1-1085
ccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtca

SEQ ID NO: 127889 - DNA, 1725 bp, Homo sapiens
  Payload ID: 5037
  Gene Symbol: DDC
  Gene Name: dopa decarboxylase (aromatic L-amino acid decarboxylase)
  ENST ID: ENST00000444733
  CDS Start-End: 70-759
ggagagagagaggacagagagcaagtcactcccggctgcctttttcacctctgacagagcccagacaccatgaacgcaagtgaattccgaaggagagggaaggagatggtggattacatggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatcttttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaaata

SEQ ID NO: 127890 - DNA, 1700 bp, Homo sapiens
  Payload ID: 5037
  Gene Symbol: DDC
  Gene Name: dopa decarboxylase (aromatic L-amino acid decarboxylase)
  Uniprot ID: P20711
  ENST ID: ENST00000426377
  CDS Start-End: 70-1278
ggagagagagaggacagagagcaagtcactcccggctgcctttttcacctctgacagagcccagacaccatgaacgcaagtgaattccgaaggagagggaaggagatggtggattacatggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctgggggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaaata

SEQ ID NO: 127891 - DNA, 1620 bp, Homo sapiens
  Payload ID: 5037
  Gene Symbol: DDC
  Gene Name: dopa decarboxylase (aromatic L-amino acid decarboxylase)
  Uniprot ID: P20711
  ENST ID: ENST00000431062
  CDS Start-End: 35-1198
ctgcagttttcacctctgacagagcccagacaccatgaacgcaagtgaattccgaaggagagggaaggagatggtggattacatggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcggcaagcccagcatgcacagagctggagactgtgatgatggactggctcgggaagatgctggaactaccaaaggcatttttgaatgagaaagctggagaagggggaggagtgatccagatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaaata

SEQ ID NO: 127892 - DNA, 2041 bp, Homo sapiens
  Payload ID: 5037
  Gene Symbol: DDC
  Gene Name: dopa decarboxylase (aromatic L-amino acid decarboxylase)
  Uniprot ID: P20711
  ENST ID: ENST00000444124
  CDS Start-End: 202-1644
ggcacatgtggctggaaatgcaagaagagggaaacgtgtggcttggagtttcaagaagagtgactgtctcagtgccgagtgcctcagcagcttctccacatgctcttcagtccccaaagttggagaatcccatcaaggagagtagccctgtaaggaattcgaatttccagcatttttcacctctgacagagcccagacaccatgaacgcaagtgaattccgaaggagagggaaggagatggtggattacatggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatg

SEQ ID NO: 127893 - DNA, 460 bp, Homo sapiens
  Payload ID: 5037
  Gene Symbol: DDC
  Gene Name: dopa decarboxylase (aromatic L-amino acid decarboxylase)
  ENST ID: ENST00000420203
  CDS Start-End: 369-460
gcaatccagtgtgtaggtccagggcgacaagcgctgctcccatggctggggtaagtccctccagcattcagccttgctccctgtgcttatctggatgcggtgtaggatgaagatgaccctatagaactctaccctggaagtcctggcaaagtggatatgtgacatttttgaaaccagggacatgttggtgctgcttaatatttaaatcataattttcagactcttaaaaattactaaataagtttgaagagacacagccatctgcctacagtgccacccctgagcttcacgccaccctggtctccaggaaaggggagagtctcaggaatattgaatgcagttttcacctctgacagagcccagacaccatgaacgcaagtgaattccgaaggagagggaaggagatggtggattacatggccaactacatggaaggcattgagggacgccaggtctaccc

SEQ ID NO: 127894 - DNA, 1809 bp, Homo sapiens
  Payload ID: 5037
  Gene Symbol: DDC
  Gene Name: dopa decarboxylase (aromatic L-amino acid decarboxylase)
  ENST ID: ENST00000617822
  CDS Start-End: 87-1385
aactgtcactgtggagaggagagagagaggacagagagcaagtcactcccggctgcctttttcacctctgacagagcccagacaccatgaacgcaagtgaattccgaaggagagggaaggagatggtggattacatggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcagatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaaatact

SEQ ID NO: 127895 - DNA, 1839 bp, Homo sapiens
  Payload ID: 5037
  Gene Symbol: DDC
  Gene Name: dopa decarboxylase (aromatic L-amino acid decarboxylase)
  ENST ID: ENST00000622873
  CDS Start-End: 87-1415
aactgtcactgtggagaggagagagagaggacagagagcaagtcactcccggctgcctttttcacctctgacagagcccagacaccatgaacgcaagtgaattccgaaggagagggaaggagatggtggattacatggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggcggcaagcccagcatgcacagagctggagactgtgatgatggactggctcgggaagatgctggaactaccaaaggcatttttgaatgagaaagctggagaagggggaggagtgatccagggaagtgccagtgaagccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaaatact

SEQ ID NO: 127896 - DNA, 1674 bp, Homo sapiens
  Payload ID: 5037
  Gene Symbol: DDC
  Gene Name: dopa decarboxylase (aromatic L-amino acid decarboxylase)
  Uniprot ID: P20711
  ENST ID: ENST00000615193
  CDS Start-End: 87-1250
aactgtcactgtggagaggagagagagaggacagagagcaagtcactcccggctgcctttttcacctctgacagagcccagacaccatgaacgcaagtgaattccgaaggagagggaaggagatggtggattacatggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctgggcggcaagcccagcatgcacagagctggagactgtgatgatggactggctcgggaagatgctggaactaccaaaggcatttttgaatgagaaagctggagaagggggaggagtgatccagatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtaggagtgaagccagctgcaggaatcaaaaattgaagagagatatatctgaaaactggaataagaagcaaataaatatcatcctgccttcatggaactcagctgtctgtggcttcccatgtctttctccaaagttatccagagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcctaataaacaattcaagtgaaatact

SEQ ID NO: 127897 - DNA, 5064 bp, Homo sapiens
  Payload ID: 5038
  Gene Symbol: DCT
  Gene Name: dopachrome tautomerase
  Uniprot ID: P40126
  ENST ID: ENST00000377028
  CDS Start-End: 415-1974
gcaattaaagtcaagagctaaggagggagggagagggtttagaaataccagcataataagtagtatgactgggtgctctgtaaattaactcaattagacaaagcctgacttaacgggggaagatggtgagaagcgctaccctcattaaatttggttgttagaggcgcttctaaggaaattaagtctgttagttgtttgaatcacataaaattgtgtgtgcacgttcatgtacacatgtgcacacatgtaacctctgtgattcttgtgggtatttttttaagaagaaaggaatagaaagcaaagaaaaataaaaaatactgaaaagaaaagactgaaagagtagaagataaggagaaaagtacgacagagacaaggaaagtaagagagagagagagctctcccaattataaagccatgagccccctttggtgggggtttctgctcagttgcttgggctgcaaaatcctgccaggagcccagggtcagttcccccgagtctgcatgacggtggacagcctagtgaacaaggagtgctgcccacgcctgggtgcagagtcggccaatgtctgtggctctcagcaaggccgggggcagtgcacagaggtgcgagccgacacaaggccctggagtggtccctacatcctacgaaaccaggatgaccgtgagctgtggccaagaaaattcttccaccggacctgcaagtgcacaggaaactttgccggctataattgtggagactgcaagtttggctggaccggtcccaactgcgagcggaagaaaccaccagtgattcggcagaacatccattccttgagtcctcaggaaagagagcagttcttgggcgccttagatctcgcgaagaagagagtacaccccgactacgtgatcaccacacaacactggctgggcctgcttgggcccaatggaacccagccgcagtttgccaactgcagtgtttatgatttttttgtgtggctccattattattctgttagagatacattattaggaccaggacgcccctacagggccatagatttctcacatcaaggacctgcatttgttacctggcaccggtaccatttgttgtgtctggaaagagatctccagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgatagcttggatgactacaaccacctggtcaccttgtgcaatggaacctatgaaggtttgctgagaagaaatcaaatgggaagaaacagcatgaaattgccaaccttaaaagacatacgagattgcctgtctctccagaagtttgacaatcctcccttcttccagaactctaccttcagtttcaggaatgctttggaagggtttgataaagcagatgggactctggattctcaagtgatgagccttcataatttggttcattccttcctgaacgggacaaacgctttgccacattcagccgccaatgatcccatttttgtggttcttcattcctttactgatgccatctttgatgagtggatgaaaagatttaatcctcctgcagatgcctggcctcaggagctggcccctattggtcacaatcggatgtacaacatggttcctttcttccctccagtgactaatgaagaactctttttaacctcagaccaacttggctacagctatgccatcgatctgccagtttcagttgaagaaactccaggttggcccacaactctcttagtagtcatgggaacactggtggctttggttggtctttttgtgctgttggcttttcttcaatatagaagacttcgaaaaggatatacacccctaatggagacacatttaagcagcaagagatacacagaagaagcctagggtgctcatgccttacctaagagaagaggctggccaagccacagttctgacgctgacaataaaggaactaatcctcactgttccttcttgagttgaagatctttgacataggttcttctatagtgatgatgatctcattcagaagatgcttagctgtagtttccgctttgcttgcttgtttaacaaacccaactaaagtgcttgaggctacctctaccttcaaataaagatagacctgacaatttgtgatatctaataataaccccccccccaatattgattaagcctcctccttttctgaaagcatttaaaaaaaaacaaaaaaaatcccaaaacattgatccaggggagtcatttaaatttgcaggtcagtgcaatgtgagacctggccaagaccatacatcaatctttcttagccccagtgtctttattggtaatgccatggaggtgggagttggtaggtgctagatgagtctccaagatcccttttagctataaacatctctgcttctaggcaccctcctgattatcttccttgggcttctttttcttcttttctctatatttttcctctccagcttagaagatgagaataagccttgttttctttacaggatggaaaatgactaaatgaaggatcaattccactctattgtgtaaactagattttacggattttacttaaaatctgcagttttaaacagtagacctatattacaggattcaatagctggatacacattgattctatagtgataaatagagaagataataaaattatagagtttcctggttagttgatatgctactgtaaacctattaacaaatacagaattactctttccaaggaaggctgactgaaggctggtgaggctgtaaacctgaacatgagacaatttgacttgagtcccattactctgaggtctctttggctgatcctctaccaatttctttactaggtagcctcagatgaaaaattattcccacataatgcactgggcttatttttaagcattgatgttagattgattaatgttgccgaatactcacagttacttatgaatgctgatcaattaagtcttatcatttgaaagcaaaccatctgtacaaaacatgacaattcagaattaagtggttatattctgctatgcaatcatcagatcatgaggaataagaatgagacaatctttactacgatgttcagacttatcatgatggaccccacttcagagaagttaatggctcttgagatttccaggcaaatttcatctgctcatatctggtttctgtgcatcaggagtgagactgaagttctagggcgtggcttgtctgtcgaggcccctctctactggaatgaatgaatgtaaagaatgggtgttaagaggtccctggagctgccttcaacataaggggtcctagagggtgcaagactcatcaagaaccagtttaccccatgcaaaaggactgctaaagccagagaaatggacaaagcccagttggaactgaatttgaatctcataaagctacaggtgcatctgagagcaggctcagtggtgaagatcaagatagcccggtaaagccctgcttgggctttttagcctcagccacatggatacctctcagttcctgccattaacaatattcatggaaaatacagcactgtgtctttcacatgctccactctggaaggtttatgctctgagctcaggatagttggggaacacatttttaaatcttggttttaaacaaaaagagaaatttattaaaatggagatataattgtgcatggtacatatatttctgaaaagttatgtataaatcaattatgttaaaagcgccagaagttactttttataagtgaactattacgaataatttcataaagcaaataaccacctctagcttatctgtcaggtatatcagaattctcatatatcatagtctcataagacttggttaaagcagatctatcttaggtaggaaaaaatagtaatcgattatacttagctgcttttatctgtagtgtgggtgactttttataactattatgttttataatgtcttcctgagagaatttcctaattttgtagttcatataagagaaatacaattttctagcattttctgaccttacaataaatcaattatgaatgcattttaacaaatattaaggtaggataaaccaacagaataaaaagttggtatttacttacattgaatatcatgcaaataaactcagaaaatgtcaccaaatactgtgggctatatttctcaatgatagggggaagaattcaaccttggagaaaatgaccagatcactttactgcttatatcttcagtattagaaaaactgcatgtatgattttaatagaaatgctttttataaagctaacattcagaaatgggataaaatgcaataacatctttcctttgtgcattaaattcccttctaattctaaaattgacatttgtatcttgcttaggatttaacattgttaattataatacttttaatgactagttttaatctcattattaagaagtagaaaacttactaaaaaggaaactaaaaataaatgttgttttgcagattattgtttgtcttttgaggattattgttttttaagtagtgtgcatcaattcccatcttttgggcactcagcatgtatattgaaatatatatacatgtaaaatatataataacaacctcagtctgaaaaataatctcttaaactgatatgctattttctggtgagtttccaaacaattgctattttctgaatctgtttgaacaggtaggaaaaggagagccagcctttcctcaggtgaagttacttttgatattccccacagtttagtgactaatcctggggtggaagcaggtggctgcttcaagtgactgaccagggaagagaggtcctgcagtagctaacttggtgatctcccagataagccttcaagatgggtcaatttgttggagactctaaggttgaagctcttcctatttctatagtgccttacttatcctgagtattttataaatattctttgaatgaataagtgaatgaataaactaatttcaaagtagaa

SEQ ID NO: 127898 - DNA, 2395 bp, Homo sapiens
  Payload ID: 5038
  Gene Symbol: DCT
  Gene Name: dopachrome tautomerase
  Uniprot ID: P40126
  ENST ID: ENST00000446125
  CDS Start-End: 428-2086
aactgagttcaaggcaattaaagtcaagagctaaggagggagggagagggtttagaaataccagcataataagtagtatgactgggtgctctgtaaattaactcaattagacaaagcctgacttaacgggggaagatggtgagaagcgctaccctcattaaatttggttgttagaggcgcttctaaggaaattaagtctgttagttgtttgaatcacataaaattgtgtgtgcacgttcatgtacacatgtgcacacatgtaacctctgtgattcttgtgggtatttttttaagaagaaaggaatagaaagcaaagaaaaataaaaaatactgaaaagaaaagactgaaagagtagaagataaggagaaaagtacgacagagacaaggaaagtaagagagagagagagctctcccaattataaagccatgagccccctttggtgggggtttctgctcagttgcttgggctgcaaaatcctgccaggagcccagggtcagttcccccgagtctgcatgacggtggacagcctagtgaacaaggagtgctgcccacgcctgggtgcagagtcggccaatgtctgtggctctcagcaaggccgggggcagtgcacagaggtgcgagccgacacaaggccctggagtggtccctacatcctacgaaaccaggatgaccgtgagctgtggccaagaaaattcttccaccggacctgcaagtgcacaggaaactttgccggctataattgtggagactgcaagtttggctggaccggtcccaactgcgagcggaagaaaccaccagtgattcggcagaacatccattccttgagtcctcaggaaagagagcagttcttgggcgccttagatctcgcgaagaagagagtacaccccgactacgtgatcaccacacaacactggctgggcctgcttgggcccaatggaacccagccgcagtttgccaactgcagtgtttatgatttttttgtgtggctccattattattctgttagagatacattattaggaccaggacgcccctacagggccatagatttctcacatcaaggacctgcatttgttacctggcaccggtaccatttgttgtgtctggaaagagatctccagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgatagcttggatgactacaaccacctggtcaccttgtgcaatggaacctatgaaggtttgctgagaagaaatcaaatgggaagaaacagcatgaaattgccaaccttaaaagacatacgagattgcctgtctctccagaagtttgacaatcctcccttcttccagaactctaccttcagtttcaggaatgctttggaagggtttgataaagcagatgggactctggattctcaagtgatgagccttcataatttggttcattccttcctgaacgggacaaacgctttgccacattcagccgccaatgatcccatttttgtggtgatttctaatcgtttgctttacaatgctacaacaaacatccttgaacatgtaagaaaagagaaagcgaccaaggaactcccttccctgcatgtgctggttcttcattcctttactgatgccatctttgatgagtggatgaaaagatttaatcctcctgcagatgcctggcctcaggagctggcccctattggtcacaatcggatgtacaacatggttcctttcttccctccagtgactaatgaagaactctttttaacctcagaccaacttggctacagctatgccatcgatctgccagtttcagttgaagaaactccaggttggcccacaactctcttagtagtcatgggaacactggtggctttggttggtctttttgtgctgttggcttttcttcaatatagaagacttcgaaaaggatatacacccctaatggagacacatttaagcagcaagagatacacagaagaagcctagggtgctcatgccttacctaagagaagaggctggccaagccacagttctgacgctgacaataaaggaactaatcctcactgttccttcttgagttgaagatctttgacataggttcttctatagtgatgatgatctcattcagaagatgcttagctgtagtttccgctttgcttgcttgtttaacaaacccaactaaagtgcttgaggctacctctaccttcaaataaagatagacctgacaatttgtgatatctaataataaccccccccccaatattgattaagcctcctccttttctgaaagcattt

SEQ ID NO: 127899 - DNA, 1548 bp, Homo sapiens
  Payload ID: 5038
  Gene Symbol: DCT
  Gene Name: dopachrome tautomerase
  ENST ID: ENST00000483392
  CDS Start-End: 1-702
tattctgttagagatacattattaggaccaggacgcccctacagggccatagatttctcacatcaaggacctgcatttgttacctggcaccggtaccatttgttgtgtctggaaagagatctccagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgatagcttggatgactacaaccacctggtcaccttgtgcaatggaacctatgaaggtttgctgagaagaaatcaaatgggaagaaacagcatgaaattgccaaccttaaaagacatacgagattgcctgtctctccagaagtttgacaatcctcccttcttccagaactctaccttcagtttcaggaatgctttggaagggtttgataaagcagatgggactctggattctcaagtgatgagccttcataatttggttcattccttcctgaacgggacaaacgctttgccacattcagccgccaatgatcccatttttgtgaaaagagaaagcgaccaaggaactcccttccctgcatgtgctggtaaccatgagcctgggaggctctactcagactttcttttgctggcataacagcaagaattcaagtgagagtttatgaaatgagtagacagaagagtattcctggttcttcattcctttactgatgccatctttgatgagtggatgaaaagatttaatcctcctgcagatgcctggcctcaggagctggcccctattggtcacaatcggatgtacaacatggttcctttcttccctccagtgactaatgaagaactctttttaacctcagaccaacttggctacagctatgccatcgatctgccagtttcagttgaagaaactccaggttggcccacaactctcttagtagtcatgggaacactggtggctttggttggtctttttgtgctgttggcttttcttcaatatagaagacttcgaaaaggatatacacccctaatggagacacatttaagcagcaagagatacacagaagaagcctagggtgctcatgccttacctaagagaagaggctggccaagccacagttctgacgctgacaataaaggaactaatcctcactgttccttcttgagttgaagatctttgacataggttcttctatagtgatgatgatctcattcagaagatgcttagctgtagtttccgctttgcttgcttgtttaacaaacccaactaaagtgcttgaggctacctctaccttcaaataaagatagacctgacaatttgtgatatctaataataaccccccccccaatattgattaagcctcctccttttctgaaagcatttaaaaaaaaacaaaaaaaatcccaaaacattgatccaggggagtcatttaaatttgcaggtcagtgcaatgtgagacctggccaagaccatacatcaatcttt

SEQ ID NO: 127900 - DNA, 769 bp, Homo sapiens
  Payload ID: 5039
  Gene Symbol: DBH
  Gene Name: dopamine beta-hydroxylase (dopamine beta-monooxygenase)
  ENST ID: ENST00000263611
  CDS Start-End: 37-769
gccctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaagg

SEQ ID NO: 127901 - DNA, 2763 bp, Homo sapiens
  Payload ID: 5039
  Gene Symbol: DBH
  Gene Name: dopamine beta-hydroxylase (dopamine beta-monooxygenase)
  Uniprot ID: P09172
  ENST ID: ENST00000393056
  CDS Start-End: 13-1866
ctcaccccagccatgcccgccctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaagacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacagaagaccgggagctggccacagtggggggcttcgggatcctggaggagatgtgtgtcaactacgtgcactactacccccagacgcagctggagctctgcaagagcgctgtggacgccggcttcctgcagaagtacttccacctcatcaacaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggcacccactggaggtggg

SEQ ID NO: 127902 - DNA, 4054 bp, Homo sapiens
  Payload ID: 5040
  Gene Symbol: DRD1
  Gene Name: dopamine receptor D1
  Uniprot ID: P21728
  ENST ID: ENST00000393752
  CDS Start-End: 994-2334
gtgccccgcgggaaccccgccggcctgtgcgcttgctggtgccagctcggctcgctgcctcgcattgccacaggctcctgagaggtcgcgggcagtgcctgcggggaggcgcggggccctgctctgtagggctgaaggccgcccgaggttcgccaaggctctgggctctcgaaaggaagccaagaaaagaagctgcccaggtgaccagtcctgggagtgctctctcccaaggaagctccgagcgcccaggagcccttagccggggtctagtgccctttgaacaatctccagctcttcaaggaagtgggctgccgccgcctctcttgggacctggcctgggatcctttccccaaacgcaccccggcgatttttgcgcaccgggagccgaacccctgctgcgcgcagctggctgggctcaggcgcgcttcctcaacgtttcggagccgctgcccccagcgaagtccacattccaagctccaggggctttgagagagacgaccccaaggcaaggcgtttggagagctgctgaggagccaggggcttggaggagcgagaagacatgtattttcagctgagtctcagaaggggagaatctcctgtcaccaccagaaaagcaacagccccgaaatgtgattgcaactgactagcagagcagaggcccaggagtcactggattgatgatttagaatatgctaaaaagccagtgctttatttggggaattcaggggctttctggtgcccaagacagtgacctgcagcaagggagtcagaagacagatgtagaaatcaagagtgaccatccacgggattgacttggattgccactcaagcggtcctctcatggaatgttggtgaggccctctgccagggaagcaatctggctgtgcaaagtgctgcctggtggggaggactcctggaaatctgactgacccctattccctgcttgggaacttgaggggtgtcagagcccctgatgtgctttctcttaggaagatgaggactctgaacacctctgccatggacgggactgggctggtggtggagagggacttctctgttcgtatcctcactgcctgtttcctgtcgctgctcatcctgtccacgctcctggggaacacgctggtctgtgctgccgttatcaggttccgacacctgcggtccaaggtgaccaacttctttgtcatctccttggctgtgtcagatctcttggtggccgtcctggtcatgccctggaaggcagtggctgagattgctggcttctggccctttgggtccttctgtaacatctgggtggcctttgacatcatgtgctccactgcatccatcctcaacctctgtgtgatcagcgtggacaggtattgggctatctccagccctttccggtatgagagaaagatgacccccaaggcagccttcatcctgatcagtgtggcatggaccttgtctgtactcatctccttcatcccagtgcagctcagctggcacaaggcaaaacccacaagcccctctgatggaaatgccacttccctggctgagaccatagacaactgtgactccagcctcagcaggacatatgccatctcatcctctgtaataagcttttacatccctgtggccatcatgattgtcacctacaccaggatctacaggattgctcagaaacaaatacggcgcattgcggccttggagagggcagcagtccacgccaagaattgccagaccaccacaggtaatggaaagcctgtcgaatgttctcaaccggaaagttcttttaagatgtccttcaaaagagaaactaaagtcctgaagactctgtcggtgatcatgggtgtgtttgtgtgctgttggctacctttcttcatcttgaactgcattttgcccttctgtgggtctggggagacgcagcccttctgcattgattccaacacctttgacgtgtttgtgtggtttgggtgggctaattcatccttgaaccccatcatttatgcctttaatgctgattttcggaaggcattttcaaccctcttaggatgctacagactttgccctgcgacgaataatgccatagagacggtgagtatcaataacaatggggccgcgatgttttccagccatcatgagccacgaggctccatctccaaggagtgcaatctggtttacctgatcccacatgctgtgggctcctctgaggacctgaaaaaggaggaggcagctggcatcgccagacccttggagaagctgtccccagccctatcagtcatattggactatgacactgacgtctctctggagaagatccaacccatcacacaaaacggtcagcacccaacctgaactcgcagatgaatcctgccacacatgctcatcccaaaagctagaggagattgctctggggcttgctattaagaaactaaggtacggtgagactctgaggtgtcaggagagccctctgctgctttccaacacacaattaactccgtttccaaatacattccagtgtattttctgtgttgttcatagtcaatcaaacagggacactacaaacatggggagccataagggacatgtctttggcttcagaattgtttttagaaatttattcttatcttaggatttaccaaatagggcaaagaatcaacagtgaacagcttcacttaaaatcaaatttttctgggaagaaaatgagatgggttgagtttgctgtatacaaacaggtgctaacactgttcccagcaaagttttcagattgtaaaggtaggtgcatgccttcataaattatttctaaaacattaattgaggcttacagtaggagtgagaaatttttttccagaattgagagatgttttgttgatattggttctatttatttattgtatatatggatatttttaatttatgatataataaatatatatttatcatatttaataggataaattaatgagttttatccaagaccttacaaccacatttctggccatttaactagcactttataagccaatgaagcaaacacacagactctgtgagattctaaatgttcatgtgtaacttctagaaacacagcagaaactgatagataagggaataaagttgaaatgattccttaaaattcatggacacagataaatgcaaggtgagaattgacaaatgctataaatgctttctttttctgaaaagattttgaaaaatttaaaaaagtatagctactactgtgttcaaaacgttttaaatgacaaatgactttcccaggggaatttgcagttctgtaaatatcttaaataaaagccaacttaagaagagcccagcattaaatttacgatcttaggtggtaatgaaaagtatatgctgctttgtatttatgtaaaataattggccctctccatcttttctcatttcatgtgtcaggtagtttttctgaaccacacaaatggctttcctggagagagatctgtagcacagacagtgggttacagcagccccactgagggaccaaactcaaaccctgcatttccatcttaccaggtcaaaccaaaccagtcagtggggctactttttatagtgctttaatctgaatttagagctgatttttaaaggagtctttaaatgttaatggtatactaactaacgaatagtgcctcattatcattcttgagtcagatacttctgttgatgggagaaacagaagaatccttccctttgggtgtgttgagctcccccaaagccatcagcatctcttttgacaaatgctagtcctttctctgtgctttggaatcaggttcctgcatcatcacccggactgtaaaaagtatcataagcctcccttgccagatgccaactcgtggggcatttcaacagagtttctttgaaatgtttacaacgtattcttcttgataagcaatgaacttaacatttagatgcaatccgtgaaaagaaaaaaaaatctgaaaaatatctcctgcatcaggtctgtgttatttatgtattgtgaatgttttcttaattttattggctgtatgctttcttacacataataaaaatattttgtgaactc

SEQ ID NO: 127903 - DNA, 2433 bp, Homo sapiens
  Payload ID: 5041
  Gene Symbol: DRD2
  Gene Name: dopamine receptor D2
  Uniprot ID: P14416
  ENST ID: ENST00000346454
  CDS Start-End: 77-1321
agcagccggcgccgtctctgcccccgggcgccctatggcttgaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaaggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccggccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtca

SEQ ID NO: 127904 - DNA, 2789 bp, Homo sapiens
  Payload ID: 5041
  Gene Symbol: DRD2
  Gene Name: dopamine receptor D2
  Uniprot ID: P14416
  ENST ID: ENST00000362072
  CDS Start-End: 346-1677
ccggcagcctcacgcgcgcaccgcgccgcctccgccccgtccccgcgctccctcctgcccgcccgccccgcgcccggccccgccccgccccgccccgccgcggcccgtccactgctccccgcgggccagagccggccgagctgctgcccgccggggctctgaacggcgcggcggggccgggagccagggaccggccgaggagagtggcggccccggacggctgccggaggggcggccgcgcgtggatgcggcgggagctggaagcctcaagcagccggcgccgtctctgcccccgggcgccctatggcttgaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccggccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtca

SEQ ID NO: 127905 - DNA, 1493 bp, Homo sapiens
  Payload ID: 5041
  Gene Symbol: DRD2
  Gene Name: dopamine receptor D2
  Uniprot ID: P14416
  ENST ID: ENST00000538967
  CDS Start-End: 1-1338
atggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggtgcaggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccggccagcctcacccttgcgaaccgtgagcaggaaggcctgggtggatcggcctcctcttcaccccggcaggccctgcagtgttcgcttggctccatgctcctca

SEQ ID NO: 127906 - DNA, 714 bp, Homo sapiens
  Payload ID: 5041
  Gene Symbol: DRD2
  Gene Name: dopamine receptor D2
  ENST ID: ENST00000543292
  CDS Start-End: 183-714
gccagatgctgactgcctgtcagaattcagtccctacacaccccgccccatgtctgtctgtcttgcttcatggaccactcacaccccagagttccgcctgccttctctgttgcccaccaaacccgtgtgtgtttgttcgttcatatgcaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcag

SEQ ID NO: 127907 - DNA, 2473 bp, Homo sapiens
  Payload ID: 5041
  Gene Symbol: DRD2
  Gene Name: dopamine receptor D2
  ENST ID: ENST00000544518
  CDS Start-End: 34-1362
agagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccggccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtc

SEQ ID NO: 127908 - DNA, 443 bp, Homo sapiens
  Payload ID: 5041
  Gene Symbol: DRD2
  Gene Name: dopamine receptor D2
  ENST ID: ENST00000542616
  CDS Start-End: 422-443
actgctccccgcgggccagagccggccgagctgctgcccgccggggctctgaacggcgcggcggggccgggagccagggaccggccgaggagagtggcggccccggacggctgccggaggggcggccgcgcgtggatgcggcgggagctggaagcctcaagcagccggcgccgtctctgcccccgggcgccctatggcttgaagtgcaggcgacggtggcggcagtagcggagggtgaccgcccggctctcggcccggctctatgatggaccgagagcccctctagggtggtatgcggagacaagagacacctctaagcaccagacagagcgcttccctatccctgtctgaggcgggcagcccttgagtgcttcctcttgaagagcagagagcctggccacccagtggctccaccgccctgatggatccactgaatctgtcct

SEQ ID NO: 127909 - DNA, 2467 bp, Homo sapiens
  Payload ID: 5041
  Gene Symbol: DRD2
  Gene Name: dopamine receptor D2
  Uniprot ID: P14416
  ENST ID: ENST00000542968
  CDS Start-End: 322-1653
ttaagaagtgtttgttgaatgaataaataaatgatggatcagctctgttcaagctcatcttattatgcatttttaaaaaattgtgtttgctcatttgtcctaccagctgtaaaaacttgctagcaaaagagtggcagaaggcccaacatttttagaaaattcttagccgtaaaccttaaaatcccgagttggaaaattctcattattaaatgccaggagttggtcttcttcctggagacctctgcaagaggccctctcactgacaccttgtgtccatttttcctggccagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccggccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactc

SEQ ID NO: 127910 - DNA, 1541 bp, Homo sapiens
  Payload ID: 5042
  Gene Symbol: DRD3
  Gene Name: dopamine receptor D3
  ENST ID: ENST00000295881
  CDS Start-End: 432-1535
gatagagagacaaagaggaaaagagagcgaggtagaaaacggatactgcctatgcctactccatccctctttcagcaccaaggacagaacctctgagcggctgacccaagcaacgctcagtttagggtccctcccaaatcctctaaagaaaacggatacattcgaaagcagctatgaaacatgcactaaggtctaatagggaagctggaaaagcagcactcaagtaatttcaccttagaggcaaaaatgggtgatttctttctgttcatttcatagtttctgagtcctgagaaaggcaaagtttgctttgcttgggtatgtctgctgtcagtaaatggctgcaggagccgaagtggtaaactcctcggtctccagaaatcagaagaaaattttagggaagccccttggcatcacgcacctccctctgggctatggcatctctgagccagctgagtggccacctgaactacacctgtggggcagagaactccacaggtgccagccaggcccgcccacatgcctactatgccctctcctactgcgcgctcatcctggccatcgtcttcggcaatggcctggtgtgcatggctgtgctgaaggagcgggccctgcagactaccaccaactacttagtagtgagcctggctgtggcagacttgctggtggccaccttggtgatgccctgggtggtatacctggaggtgacaggtggagtctggaatttcagccgcatttgctgtgatgtttttgtcaccctggatgtcatgatgtgtacagccagcatccttaatctctgtgccatcagcatagacaggtacactgcagtggtcatgcccgttcactaccagcatggcacgggacagagctcctgtcggcgcgtggccctcatgatcacggccgtctgggtactggcctttgctgtgtcctgccctcttctgtttggctttaataccacaggggaccccactgtctgctccatctccaaccctgattttgtcatctactcttcagtggtgtccttctacctgccctttggagtgactgtccttgtctatgccagaatctatgtggtgctgaaacaaaggagacggaaaaggatcctcactcgacagaacagtcagtgcaacagtgtcaggcctggcttcccccagcaaaccctctctcctgacccggcacatctggagctgaagcgttactacagcatctgccaggacactgccttgggtggaccaggcttccaagaaagaggaggagagttgaaaagagaggagaagactcggaattccctgatgccacttcgggagaagaaggcaacccaaatggtggccattgtgcttggggccttcattgtctgctggctgcccttcttcttgacccatgttctcaatacccactgccagacatgccacgtgtccccagagctttacagtgccacgacatggctgggctacgtgaatagcgccctcaaccctgtgatctataccaccttcaatatcgagttccggaaagccttcctcaagatcctgtcttgctgagggagc

SEQ ID NO: 127911 - DNA, 1640 bp, Homo sapiens
  Payload ID: 5042
  Gene Symbol: DRD3
  Gene Name: dopamine receptor D3
  Uniprot ID: P35462
  ENST ID: ENST00000383673
  CDS Start-End: 432-1634
gatagagagacaaagaggaaaagagagcgaggtagaaaacggatactgcctatgcctactccatccctctttcagcaccaaggacagaacctctgagcggctgacccaagcaacgctcagtttagggtccctcccaaatcctctaaagaaaacggatacattcgaaagcagctatgaaacatgcactaaggtctaatagggaagctggaaaagcagcactcaagtaatttcaccttagaggcaaaaatgggtgatttctttctgttcatttcatagtttctgagtcctgagaaaggcaaagtttgctttgcttgggtatgtctgctgtcagtaaatggctgcaggagccgaagtggtaaactcctcggtctccagaaatcagaagaaaattttagggaagccccttggcatcacgcacctccctctgggctatggcatctctgagccagctgagtggccacctgaactacacctgtggggcagagaactccacaggtgccagccaggcccgcccacatgcctactatgccctctcctactgcgcgctcatcctggccatcgtcttcggcaatggcctggtgtgcatggctgtgctgaaggagcgggccctgcagactaccaccaactacttagtagtgagcctggctgtggcagacttgctggtggccaccttggtgatgccctgggtggtatacctggaggtgacaggtggagtctggaatttcagccgcatttgctgtgatgtttttgtcaccctggatgtcatgatgtgtacagccagcatccttaatctctgtgccatcagcatagacaggtacactgcagtggtcatgcccgttcactaccagcatggcacgggacagagctcctgtcggcgcgtggccctcatgatcacggccgtctgggtactggcctttgctgtgtcctgccctcttctgtttggctttaataccacaggggaccccactgtctgctccatctccaaccctgattttgtcatctactcttcagtggtgtccttctacctgccctttggagtgactgtccttgtctatgccagaatctatgtggtgctgaaacaaaggagacggaaaaggatcctcactcgacagaacagtcagtgcaacagtgtcaggcctggcttcccccagcaaaccctctctcctgacccggcacatctggagctgaagcgttactacagcatctgccaggacactgccttgggtggaccaggcttccaagaaagaggaggagagttgaaaagagaggagaagactcggaattccctgagtcccaccatagcgcccaagctcagcttagaagttcgaaaactcagcaatggcagattatcgacatctttgaagctggggcccctgcaacctcggggagtgccacttcgggagaagaaggcaacccaaatggtggccattgtgcttggggccttcattgtctgctggctgcccttcttcttgacccatgttctcaatacccactgccagacatgccacgtgtccccagagctttacagtgccacgacatggctgggctacgtgaatagcgccctcaaccctgtgatctataccaccttcaatatcgagttccggaaagccttcctcaagatcctgtcttgctgagggagc

SEQ ID NO: 127912 - DNA, 1557 bp, Homo sapiens
  Payload ID: 5042
  Gene Symbol: DRD3
  Gene Name: dopamine receptor D3
  Uniprot ID: P35462
  ENST ID: ENST00000460779
  CDS Start-End: 291-1493
attataaaagcaagttcaacctcctcttgctctcaccctttcttgctcttctgccttccgccatgagatgacacagcacaaaggtctttgccagatgtctgtgccacactcttggacttcccggactccagaacttttctgagtcctgagaaaggcaaagtttgctttgcttgggtatgtctgctgtcagtaaatggctgcaggagccgaagtggtaaactcctcggtctccagaaatcagaagaaaattttagggaagccccttggcatcacgcacctccctctgggctatggcatctctgagccagctgagtggccacctgaactacacctgtggggcagagaactccacaggtgccagccaggcccgcccacatgcctactatgccctctcctactgcgcgctcatcctggccatcgtcttcggcaatggcctggtgtgcatggctgtgctgaaggagcgggccctgcagactaccaccaactacttagtagtgagcctggctgtggcagacttgctggtggccaccttggtgatgccctgggtggtatacctggaggtgacaggtggagtctggaatttcagccgcatttgctgtgatgtttttgtcaccctggatgtcatgatgtgtacagccagcatccttaatctctgtgccatcagcatagacaggtacactgcagtggtcatgcccgttcactaccagcatggcacgggacagagctcctgtcggcgcgtggccctcatgatcacggccgtctgggtactggcctttgctgtgtcctgccctcttctgtttggctttaataccacaggggaccccactgtctgctccatctccaaccctgattttgtcatctactcttcagtggtgtccttctacctgccctttggagtgactgtccttgtctatgccagaatctatgtggtgctgaaacaaaggagacggaaaaggatcctcactcgacagaacagtcagtgcaacagtgtcaggcctggcttcccccagcaaaccctctctcctgacccggcacatctggagctgaagcgttactacagcatctgccaggacactgccttgggtggaccaggcttccaagaaagaggaggagagttgaaaagagaggagaagactcggaattccctgagtcccaccatagcgcccaagctcagcttagaagttcgaaaactcagcaatggcagattatcgacatctttgaagctggggcccctgcaacctcggggagtgccacttcgggagaagaaggcaacccaaatggtggccattgtgcttggggccttcattgtctgctggctgcccttcttcttgacccatgttctcaatacccactgccagacatgccacgtgtccccagagctttacagtgccacgacatggctgggctacgtgaatagcgccctcaaccctgtgatctataccaccttcaatatcgagttccggaaagccttcctcaagatcctgtcttgctgagggagcagaagagggaacactctttgtacccatttctagctgccaggctgttggcccactcaga

SEQ ID NO: 127913 - DNA, 1554 bp, Homo sapiens
  Payload ID: 5042
  Gene Symbol: DRD3
  Gene Name: dopamine receptor D3
  Uniprot ID: P35462
  ENST ID: ENST00000467632
  CDS Start-End: 346-1548
ggtaaactcctcggtctccagaaatcagaagaaaattttaggaaagagaacaaataattaaaactctgtaagtcttaatgaggtgctaaggaggaaccccacgaatgtttcaggaagactgttattcagcactgagggattgaacatcagcaaagcaggacaaatgtcataactgatggggacctgacaactctctgttcccctgcctttttaaataggttatgcactcactctaagagatgccagaacaaactataaagaccaagataaatcaatactttgtaaggcatttaaaagctcattaaaatgtgaagccccttggcatcacgcacctccctctgggctatggcatctctgagccagctgagtggccacctgaactacacctgtggggcagagaactccacaggtgccagccaggcccgcccacatgcctactatgccctctcctactgcgcgctcatcctggccatcgtcttcggcaatggcctggtgtgcatggctgtgctgaaggagcgggccctgcagactaccaccaactacttagtagtgagcctggctgtggcagacttgctggtggccaccttggtgatgccctgggtggtatacctggaggtgacaggtggagtctggaatttcagccgcatttgctgtgatgtttttgtcaccctggatgtcatgatgtgtacagccagcatccttaatctctgtgccatcagcatagacaggtacactgcagtggtcatgcccgttcactaccagcatggcacgggacagagctcctgtcggcgcgtggccctcatgatcacggccgtctgggtactggcctttgctgtgtcctgccctcttctgtttggctttaataccacaggggaccccactgtctgctccatctccaaccctgattttgtcatctactcttcagtggtgtccttctacctgccctttggagtgactgtccttgtctatgccagaatctatgtggtgctgaaacaaaggagacggaaaaggatcctcactcgacagaacagtcagtgcaacagtgtcaggcctggcttcccccagcaaaccctctctcctgacccggcacatctggagctgaagcgttactacagcatctgccaggacactgccttgggtggaccaggcttccaagaaagaggaggagagttgaaaagagaggagaagactcggaattccctgagtcccaccatagcgcccaagctcagcttagaagttcgaaaactcagcaatggcagattatcgacatctttgaagctggggcccctgcaacctcggggagtgccacttcgggagaagaaggcaacccaaatggtggccattgtgcttggggccttcattgtctgctggctgcccttcttcttgacccatgttctcaatacccactgccagacatgccacgtgtccccagagctttacagtgccacgacatggctgggctacgtgaatagcgccctcaaccctgtgatctataccaccttcaatatcgagttccggaaagccttcctcaagatcctgtcttgctgagggagc

SEQ ID NO: 127914 - DNA, 1375 bp, Homo sapiens
  Payload ID: 5043
  Gene Symbol: DRD4
  Gene Name: dopamine receptor D4
  Uniprot ID: P21917
  ENST ID: ENST00000176183
  CDS Start-End: 13-1272
cccgggcgcgccatggggaaccgcagcaccgcggacgcggacgggctgctggctgggcgcgggccggccgcgggggcatctgcgggggcatctgcggggctggctgggcagggcgcggcggcgctggtggggggcgtgctgctcatcggcgcggtgctcgcggggaactcgctcgtgtgcgtgagcgtggccaccgagcgcgccctgcagacgcccaccaactccttcatcgtgagcctggcggccgccgacctcctcctcgctctcctggtgctgccgctcttcgtctactccgaggtccagggtggcgcgtggctgctgagcccccgcctgtgcgacgccctcatggccatggacgtcatgctgtgcaccgcctccatcttcaacctgtgcgccatcagcgtggacaggttcgtggccgtggccgtgccgctgcgctacaaccggcagggtgggagccgccggcagctgctgctcatcggcgccacgtggctgctgtccgcggcggtggcggcgcccgtactgtgcggcctcaacgacgtgcgcggccgcgaccccgccgtgtgccgcctggaggaccgcgactacgtggtctactcgtccgtgtgctccttcttcctaccctgcccgctcatgctgctgctctactgggccacgttccgcggcctgcagcgctgggaggtggcacgtcgcgccaagctgcacggccgcgcgccccgccgacccagcggccctggcccgccttcccccacgccacccgcgccccgcctcccccaggacccctgcggccccgactgtgcgccccccgcgcccggccttccccggggtccctgcggccccgactgtgcgcccgccgcgcccagcctcccccaggacccctgcggccccgactgtgcgccccccgcgcccggcctccccccggacccctgcggctccaactgtgctccccccgacgccgtcagagccgccgcgctcccaccccagactccaccgcagacccgcaggaggcggcgtgccaagatcaccggccgggagcgcaaggccatgagggtcctgccggtggtggtcggggccttcctgctgtgctggacgcccttcttcgtggtgcacatcacgcaggcgctgtgtcctgcctgctccgtgcccccgcggctggtcagcgccgtcacctggctgggctacgtcaacagcgccctcaaccccgtcatctacactgtcttcaacgccgagttccgcaacgtcttccgcaaggccctgcgtgcctgctgctgagccgggcacccccggacgccccccggcctgatggccaggcctcagggaccaaggagatggggagggcgcttttgtacgttaattaaacaaattccttcccaaa

SEQ ID NO: 127915 - DNA, 1375 bp, Homo sapiens
  Payload ID: 5043
  Gene Symbol: DRD4
  Gene Name: dopamine receptor D4
  ENST ID: ENST00000611962
  CDS Start-End: 13-1272
cccgggcgcgccatggggaaccgcagcaccgcggacgcggacgggctgctggctgggcgcgggccggccgcgggggcatctgcgggggcatctgcggggctggctgggcagggcgcggcggcgctggtggggggcgtgctgctcatcggcgcggtgctcgcggggaactcgctcgtgtgcgtgagcgtggccaccgagcgcgccctgcagacgcccaccaactccttcatcgtgagcctggcggccgccgacctcctcctcgctctcctggtgctgccgctcttcgtctactccgaggtccagggtggcgcgtggctgctgagcccccgcctgtgcgacgccctcatggccatggacgtcatgctgtgcaccgcctccatcttcaacctgtgcgccatcagcgtggacaggttcgtggccgtggccgtgccgctgcgctacaaccggcagggtgggagccgccggcagctgctgctcatcggcgccacgtggctgctgtccgcggcggtggcggcgcccgtactgtgcggcctcaacgacgtgcgcggccgcgaccccgccgtgtgccgcctggaggaccgcgactacgtggtctactcgtccgtgtgctccttcttcctaccctgcccgctcatgctgctgctctactgggccacgttccgcggcctgcagcgctgggaggtggcacgtcgcgccaagctgcacggccgcgcgccccgccgacccagcggccctggcccgccttcccccacgccacccgcgccccgcctcccccaggacccctgcggccccgactgtgcgccccccgcgcccggccttccccggggtccctgcggccccgactgtgcgcccgccgcgcccagcctcccccaggacccctgtggccccgactgtgcgccccccgcgcccggcctccccccggacccctgcggctccaactgtgctccccccgacgccgtcagagccgccgcgctcccaccccagactccaccgcagacccgcaggaggcggcgtgccaagatcaccggccgggagcgcaaggccatgagggtcctgccggtggtggtcggggccttcctgctgtgctggacgcccttcttcgtggtgcacatcacgcaggcgctgtgtcctgcctgctccgtgcccccgcggctggtcagcgccgtcacctggctgggctacgtcaacagcgccctcaaccccgtcatctacactgtcttcaacgccgagttccgcaacgtcttccgcaaggccctgcgtgcctgctgctgagccgggcacccccggacgccccccggcctgatggccaggcctcagggaccaaggagatggggagggcgcttttgtacgttaattaaacaaattccttcccaaa

SEQ ID NO: 127916 - DNA, 2330 bp, Homo sapiens
  Payload ID: 5044
  Gene Symbol: DRD5
  Gene Name: dopamine receptor D5
  Uniprot ID: P21918
  ENST ID: ENST00000304374
  CDS Start-End: 351-1784
cggcttgctctcttctctcgctccgaaccagacacagccgctgccgctgccgtccggcgcgctacagactcccgagaacagccctggctgtcagcgagcaccagccgcttcctgtccccatcgcggagactggaggggcgcaccacggccatggagccagaggcgcttcaggaggcaagagaagtccccgcgcgctccgcagcccggcgcagctcatggtgagcgccctctggggctcgagggtcccttggctgagggggcgcatcctcggggtgcccgatggggctgcctgggggtcgcagggctgaagttgggaccgcgcacagaccgcccctgcagtccagcccgaaatgctgccgccaggcagcaacggcaccgcgtacccggggcagttcgctctataccagcagctggcgcaggggaacgccgtggggggctcggcgggggcaccgccactggggccctcacaggtggtcaccgcctgcctgctgaccctactcatcatctggaccctgctgggcaacgtgctggtgtgcgcagccatcgtgcggagccgccacctgcgcgccaacatgaccaacgtcttcatcgtgtctctggccgtgtcagaccttttcgtggcgctgctggtcatgccctggaaggcagtcgccgaggtggccggttactggccctttggagcgttctgcgacgtctgggtggccttcgacatcatgtgctccactgcctccatcctgaacctgtgcgtcatcagcgtggaccgctactgggccatctccaggcccttccgctacaagcgcaagatgactcagcgcatggccttggtcatggtcggcctggcatggaccttgtccatcctcatctccttcattccggtccagctcaactggcacagggaccaggcggcctcttggggcgggctggacctgccaaacaacctggccaactggacgccctgggaggaggacttttgggagcccgacgtgaatgcagagaactgtgactccagcctgaatcgaacctacgccatctcttcctcgctcatcagcttctacatccccgttgccatcatgatcgtgacctacacgcgcatctaccgcatcgcccaggtgcagatccgcaggatttcctccctggagagggccgcagagcacgcgcagagctgccggagcagcgcagcctgcgcgcccgacaccagcctgcgcgcttccatcaagaaggagaccaaggttctcaagaccctgtcggtgatcatgggggtcttcgtgtgttgctggctgcccttcttcatccttaactgcatggtccctttctgcagtggacaccccgaaggccctccggccggcttcccctgcgtcagtgagaccaccttcgacgtcttcgtctggttcggctgggctaactcctcactcaaccccgtcatctatgccttcaacgccgactttcagaaggtgtttgcccagctgctggggtgcagccacttctgctcccgcacgccggtggagacggtgaacatcagcaatgagctcatctcctacaaccaagacatcgtcttccacaaggaaatcgcagctgcctacatccacatgatgcccaacgccgttacccccggcaaccgggaggtggacaacgacgaggaggagggtcctttcgatcgcatgttccagatctatcagacgtccccagatggtgaccctgttgctgagtctgtctgggagctggactgcgagggggagatttctttagacaaaataacacctttcaccccgaatggattccattaaactgcattaagaaaccccctcatggatctgcataaccgcacagacattgacaagcacgcacacacacgcaaatacatgcctttccagtgctgctccctttatcatgtgtttctgtgtagtagctcgtgtgcttagaaacctcaccccattgattggtagttcgaagaattggcagaagcagttgcaataaactcagtcaaatgtacccagcctaccagagatggaccaacgatcctatgagagaagagagtatggtgctgggtccttaaaaaaaaaaatgatacttggtccttaaaaaatatgctctcccctccctttttaaacaaatggcttgttcagtcacttgtttgtgtttgaattgatttttaaacagcaggttgtgtgtgtgtgcagtgatgtggtgggagcacagctttcctgggtctggattcccgtggctttgtgcttatgtcatttcttctctctgtgctggtgggggcctctttaccatagcttaagaagtatccctgatttattctggtgtctaataaacacagattatttgta

SEQ ID NO: 127917 - DNA, 8210 bp, Homo sapiens
  Payload ID: 5045
  Gene Symbol: DOPEY1
  Gene Name: dopey family member 1
  Uniprot ID: Q5JWR5
  ENST ID: ENST00000349129
  CDS Start-End: 261-7658
cgagcacggtgcactctgggagctgtcactaggcccttcggctcccggtctcggtgtagctgccgtggttgccaggagagctgcgccggcgagaagcggccgagccagcagcaggaaggaacacacaagtagttatctttcaggctgtctttgaatacttccatgaccctgaacactagctgaggagagtttcaaccactgctaacagtaatgactttacatgagtttggaactggtctctagtgggaagttgtgggaggatgaacacagaagagctggagttattgagtgactccaaatacagaaactatgtagcagcaattgacaaagcactaaagaattttgaatactccagtgaatgggcagatttgatatcagcacttggaaaacttaataaggttttacaaaataatgcaaagtaccaagtagtacccaaaaagctgaccataggcaaacgcctagctcaatgtctacatccagcattaccaggtggagttcatcggaaggcgcttgaaacatatgaaattatcttcaaaataattggacctaagcgacttgccaaagatctttttttatatagttctggattatttcctcttcttgcaaatgctgccatgtctgtgaaaccaacattgctcagtttgtatgagatatattatctgcctttgggtaaaacactgaaacctggtctacagggattgcttactggtattcttcctggcttagaagaaggatcagagtactatgagagaacaaatatgttgttggaaaaggttgctgctgctgtggaccagtcagcattctacagtgccctgtggggtagtcttctcaccagtcctgctgtgcgtttacctggaatcacgtatgttcttgcccatttaaacaggaagctttctatggaagatcaactttatataattggcagtgatattgagctaatggtagaagcagtaagtacttcagtgcaggactcaagtgtacttgtacagagaagcacactggacctcatactcttctgttttccattccacatgagtcaggccactcgaccggatatgatcaggatcttgtcagcagcccttcatgtagtgctaaggagggatatgtctctgaatcgaagactttatgcatggcttcttggttttgataacaacggtgctatcataggacccagaagcacaagacacagtaatcctgaagaacatgccacttactatttcactaccttttcaaaagaattattagtccaggcaatggtgggaatcttacaagtgaatggatttggagaagagaacactctaatgcaggatctaaagccttttcgcattttaatcagtttactggacaaacctgagctaggacctgtaattctagaagatgtcctgattgaagtgtttagaacattatattctcaatgcaaagcagagttggatcttcaaactgaaccacccttcagcaaggatcatgctcagttaagcagtaaattaagagaaaataagaaaacagcagagctgattaaaactgctaaccttctctttaattccttcgaaccttattatatgtgggattatgttgcacgctggtttgaagaatgttgtaggaggacactgcatgtgagacttcagattggacctggagatagtaatgactcatctgaattacagctgaccaatttctgcttactggtggattttttgttggacatagtttctttgcctactagaagtatgagggtgctgtgtcaggagacttacattgaaatccagacagaacacttgccccagttgctgctcagaatgatttctgccttgacaagccatctccagacattgcacttatctgaactcacagattctctcagactctgctcaaagatccttagcaaggttcagcctccactgttatctgctagcactggaggtgttttgcagtttccaagtgggcagaacaattcagtcaaagagtgggaagacaaaaaggtatcatcagtttctcatgaaaatcctactgaagtgtttgaagatggagaaaatccaccaagtagtcgatcatcagagagtggattcactgagtttatacaatatcaagcagaccgaactgatgatattgacagagaactgagtgagggccagggggcagctgccatcccaattggtagcacatcctctgagacagaaacagcatccactgtgggatctgaagaaaccatcatccagaccccttccgtagtcactcaggggacagcaacccgaagtaggaagacagcccaaaagactgcaatgcagtgctgcttggagtatgtccaacagtttcttaccagacttatcaacctctacatcattcagaataactctttttctcagtctttggctacagaacatcaaggggatcttggtcgagaacaaggagagacttcaaaatgggacagaaattcacaaggagatgtaaaagagaaaaacataagtaaacaaaaaacttctaaagaatacctgtctgccttccttgctgcctgtcagctcttcctagagtgctcaagtttcccagtttacattgctgaggggaaccatacatcagagttacgttctgaaaaattggagactgactgtgagcatgtgcagcctccacagtggctccagactctgatgaatgcttgcagccaagcaagtgatttcagtgttcagagtgttgctatttcactagttatggacctggtgggactgacacagtctgtggccatggtcactggggaaaacatcaacagtgtagagcctgcacaacccttaagtccaaaccagggaagagtagctgtggttattagacctcccctcactcagggcaatctgaggtacatagctgagaagactgaatttttcaagcatgtagctttaacattgtgggaccagttgggagatgggacacctcagcatcaccagaagagtgtggaactattttatcaattacataacttagttccttcttctagcatctgtgaggatgttataagtcagcagttaacccataaagataagaaaataaggatggaagcacatgccaagtttgcagttctttggcatctaacgagagatctccatataaataaatcttcatcttttgtacgttcttttgacaggtcactgttcatcatgttagatagccttaacagtctcgatggttctactagctctgtgggacaagcctggctgaaccaagtcctacaaagacatgatattgcacgagttttggaaccattgctattgctcctgcttcatccaaaaactcagagggtttcagtacagcgtgtacaagcagaacgttattggaataagtctccctgttatccaggagaggagagtgacaagcatttcatgcaaaattttgcctgcagcaatgtgagccaagtacaactcatcacatcaaaaggaaatggtgaaaagccacttaccatggatgaaatagagaactttagtctcactgtgaatccattaagtgacagactttccctcctaagtaccagcagtgagacaattccaatggttgtgtctgattttgatcttccagaccaacagatagaaatacttcagagttctgactcgggatgttcacagtcctctgctggggacaacttgagttacgaagttgatcctgaaaccgtgaatgcccaagaggattctcaaatgcccaaggaaagctccccagatgatgatgttcaacaggtagtatttgacctgatatgtaaagttgtaagtggcctcgaagtggaatctgcatcagttacatctcaattagaaattgaagctatgcccccaaagtgcagtgatatagatccagatgaagagacgattaaaattgaagatgactccattcaacagagtcagaatgctttgctgagtaatgaaagttctcagtttctgtctgtgtctgcagagggaggccatgagtgtgtggcaaatggaatctccaggaatagctcctcaccttgtatttcaggaaccacacacactcttcatgactcttctgttgcttccatagaaaccaaatctagacaaaggagtcacagtagtattcaattcagcttcaaagaaaaattatcagaaaaagtttcggagaaggaaacaatagttaaggagtcaggtaaacaaccaggagcaaaacctaaagtaaaacttgccagaaaaaaggatgatgacaagaaaaaatcttcaaatgaaaaactcaaacaaaccagtgtattcttcagtgatggtctggatttagagaactggtatagctgtggagagggagacatttctgaaattgagagtgacatgggttctccaggatctcgaaaatctcccaatttcaacattcatcctctctatcaacatgtgctcctgtatctccagttgtatgattcatccaggactttgtatgctttctctgccatcaaagccatcttgaaaactaaccctatagcttttgtaaatgccatttcaactactagtgtaaataatgcatatactcctcagttgtctctccttcagaatctattggccagacaccggatttctgttatgggcaaagatttttatagtcacattccagtggactcaaatcataacttccggagttctatgtacatagaaattcttatttctctctgcttatattacatgcgtagccattacccaactcatgtcaaggttactgcacaagatttaataggcaatcgaaacatgcaaatgatgagcatagaaattctgacactactcttcactgagctggcaaaagtaatagaaagctcagcgaagggtttccctagttttatttctgatatgttatctaagtgcaaagttcagaaagtgattcttcattgtttgctgtcatctatctttagtgctcagaaatggcatagtgaaaaaatggcaggtaagaacctggttgctgtggaagaaggtttctcagaggacagccttattaatttctcagaggatgaatttgacaatggcagcacgttgcagtcacaacttcttaaggtgcttcagaggctgattgttctagaacacagagtaatgactattcctgaagagaatgaaacaggttttgattttgttgtatctgacttagaacacatcagtccccatcaacccatgacttctcttcagtatttgcatgctcagccaatcacatgtcaaggcatgttcctctgtgcagtgatacgagctttgcatcagcactgtgcatgtaagatgcacccacaatggattggtttaatcacatctactctgccttacatgggaaaagttctgcagagagtggttgtttctgtgacactacaactgtgcagaaatttagataatctaattcagcagtacaaatacgaaacaggattatctgatagtaggcctctgtggatggcatcaattattccaccagatatgattcttactcttttggaagggattacagccattatccattactgtttgttggatccaactacacagtatcaccaacttttggtcagtgtagaccagaaacacttgtttgaagcacgcagtggaatcctctcaatccttcatatgatcatgtcctctgtgacactgctttggagcatactgcatcaagctgattcttcagaaaagatgactattgccgcatccgcatctcttaccactattaatcttggagctacaaagaacttgagacaacagattcttgaattgttgggccccatttcaatgaatcatggtgttcactttatggctgccattgcatttgtgtggaatgaaagaagacagaataaaacaaccaccaggaccaaggtcattcctgcagccagtgaagaacagcttttattagtggaattggttcgttcaatcagtgtcatgagagcagaaactgttatccagactgtaaaagaagttttaaagcagccaccagccatagccaaggacaagaaacatctttctttggaagtctgcatgcttcagtttttctatgcttatattcaaagaattccagtgcccaatttagtggatagctgggcgtcactgttgatacttctgaaagactctatacaactgagtcttccagctccagggcagtttcttatacttggggttctgaatgagtttattatgaaaaaccctagtttggaaaataaaaaagaccaaagagaccttcaggatgtaactcacaaaatagtggatgcaattggtgcaattgctggttcttctctggaacagacaacatggctgcgacgaaatcttgaagttaagccttctcccaaaataatggtagatggaaccaatttggaatctgatgttgaagatatgttatcacctgcaatggaaaccgcaaacataactccttctgtatatagtgtccatgcattgacattactctctgaggttttggctcatcttttggatatggttttctatagtgatgaaaaggagcgggttattcctttacttgtaaatattatgcattatgttgtgccctacctcagaaatcacagtgcacataatgcccctagttatcgagcttgtgtccagctgctcagcagtcttagtgggtatcagtacacacggagagcttggaaaaaagaagcttttgacctctttatggatcccagtttctttcagatggatgcctcttgtgttaatcattggagagcaattatggacaatctgatgacacatgataaaacaacatttagagatttgatgactcgtgtagcagtggctcaaagcagttcacttaatctctttgcaaaccgtgatgtggagctagaacagagagctatgcttcttaaaagattagcatttgctatttttagcagtgaaattgaccagtaccagaaatatcttccagatatacaagagagattggttgagagtctccgtttgccacaggtgccaactctccattctcaagtgttcctgtttttcagagtgttacttttaagaatgtctccccaacatcttacctcactctggcctaccatgattacagaacttgtacaagtatttttactgatggagcaggaactcactgctgatgaagatatttcacggacttcagggccctctgtggctggtctggagacaacgtacacaggaggtaatggcttctctacttcatataacagccagcggtggttaaacctctatctctctgcttgcaaatttttggatttggctctcgcattgccctctgaaaaccttcctcagtttcagatgtaccgatgggcctttattccagaagcctcagatgattcaggtttggaagtcagaaggcagggtatacatcaacgagaatttaaaccttacgtggtacgactagcaaaacttcttcggaaaagagcaaagaaaaatccagaggaagacaactcagggagaacattgggttgggagccagggcacttgctgctcaccatctgcaccgtgcgcagtatggagcagctcctgccgttcttcaatgtgctcagtcaagtcttcaacagcaaagtcacaagccgatgtggaggacactcagggagtcctatcctctactcaaatgccttccctaataaggacatgaaactggagaaccacaaaccatgttccagcaaagccaggcaaaaaatagaagagatggtagaaaaagattttctggaagggatgataaaaacttgagcaccattgctggttccatttagcttacatgtaaatgtaattatttaaaacacacacactgctctgcgttgtatagtttttccttttttgtatgtaacagaacacatttcagattgtatttaatttaaatatttgtatataagagcaaatgtctgaatgtggcctgaatcaagtttaaatattgttggctcatactgattatggtgcctaagagagctatatatatacacatgtaaagtccattgtttttattgtcctgagttgtcttaaacctgcaaaatatacactacccattttttttttccattggtttcagacttggttcaattaagattggttggggatttttctcttttccttattaaccatgttctggtatcagaatggtgttccttctccatcagaggctgggaaacgtattataattagtttttctcccacataccttcaccaagagcagtgaagaataactgaaggctggaccatgcatccttaaaagtattgcatgagcatctccacctcagtatggaagagggatggacaaccccctat

SEQ ID NO: 127918 - DNA, 7995 bp, Homo sapiens
  Payload ID: 5045
  Gene Symbol: DOPEY1
  Gene Name: dopey family member 1
  ENST ID: ENST00000237163
  CDS Start-End: 261-7691
cgagcacggtgcactctgggagctgtcactaggcccttcggctcccggtctcggtgtagctgccgtggttgccaggagagctgcgccggcgagaagcggccgagccagcagcaggaaggaacacacaagtagttatctttcaggctgtctttgaatacttccatgaccctgaacactagctgaggagagtttcaaccactgctaacagtaatgactttacatgagtttggaactggtctctagtgggaagttgtgggaggatgaacacagaagagctggagttattgagtgactccaaatacagaaactatgtagcagcaattgacaaagcactaaagaattttgaatactccagtgaatgggcagatttgatatcagcacttggaaaacttaataaggttttacaaaataatgcaaagtaccaagtagtacccaaaaagctgaccataggcaaacgcctagctcaatgtctacatccagcattaccaggtggagttcatcggaaggcgcttgaaacatatgaaattatcttcaaaataattggacctaagcgacttgccaaagatctttttttatatagttctggattatttcctcttcttgcaaatgctgccatgtctgtgaaaccaacattgctcagtttgtatgagatatattatctgcctttgggtaaaacactgaaacctggtctacagggattgcttactggtattcttcctggcttagaagaaggatcagagtactatgagagaacaaatatgttgttggaaaaggttgctgctgctgtggaccagtcagcattctacagtgccctgtggggtagtcttctcaccagtcctgctgtgcgtttacctggaatcacgtatgttcttgcccatttaaacaggaagctttctatggaagatcaactttatataattggcagtgatattgagctaatggtagaagcagtaagtacttcagtgcaggactcaagtgtacttgtacagagaagcacactggacctcatactcttctgttttccattccacatgagtcaggccactcgaccggatatgatcaggatcttgtcagcagcccttcatgtagtgctaaggagggatatgtctctgaatcgaagactttatgcatggcttcttggacccagaagcacaagacacagtaatcctgaagaacatgccacttactatttcactaccttttcaaaagaattattagtccaggcaatggtgggaatcttacaagtgaatggatttggagaagagaacactctaatgcaggatctaaagccttttcgcattttaatcagtttactggacaaacctgagctaggacctgtaattctagaagatgtcctgattgaagtgtttagaacattatattctcaatgcaaagcagagttggatcttcaaactgaaccacccttcagcaaggatcatgctcagttaagcagtaaattaagagaaaataagaaaacagcagagctgattaaaactgctaaccttctctttaattccttcgaaccttattatatgtgggattatgttgcacgctggtttgaagaatgttgtaggaggacactgcatgtgagacttcagattggacctggagatagtaatgactcatctgaattacagctgaccaatttctgcttactggtggattttttgttggacatagtttctttgcctactagaagtatgagggtgctgtgtcaggagacttacattgaaatccagacagaacacttgccccagttgctgctcagaatgatttctgccttgacaagccatctccagacattgcacttatctgaactcacagattctctcagactctgctcaaagatccttagcaaggttcagcctccactgttatctgctagcactggaggtgttttgcagtttccaagtgggcagaacaattcagtcaaagagtgggaagacaaaaaggtatcatcagtttctcatgaaaatcctactgaagtgtttgaagatggagaaaatccaccaagtagtcgatcatcagagagtggattcactgagtttatacaatatcaagcagaccgaactgatgatattgacagagaactgagtgagggccagggggcagctgccatcccaattggtagcacatcctctgagacagaaacagcatccactgtgggatctgaagaaaccatcatccagaccccttccgtagtcactcaggggacagcaacccgaagtaggaagacagcccaaaagactgcaatgcagtgctgcttggagtatgtccaacagtttcttaccagacttatcaacctctacatcattcagaataactctttttctcagtctttggctacagaacatcaaggggatcttggtcgagaacaaggagagacttcaaaatgggacagaaattcacaaggagatgtaaaagagaaaaacataagtaaacaaaaaacttctaaagaatacctgtctgccttccttgctgcctgtcagctcttcctagagtgctcaagtttcccagtttacattgctgaggggaaccatacatcagagttacgttctgaaaaattggagactgactgtgagcatgtgcagcctccacagtggctccagactctgatgaatgcttgcagccaagcaagtgatttcagtgttcagagtgttgctatttcactagttatggacctggtgggactgacacagtctgtggccatggtcactggggaaaacatcaacagtgtagagcctgcacaacccttaagtccaaaccagggaagagtagctgtggttattagacctcccctcactcagggcaatctgaggtacatagctgagaagactgaatttttcaagcatgtagctttaacattgtgggaccagttgggagatgggacacctcagcatcaccagaagagtgtggaactattttatcaattacataacttagttccttcttctagcatctgtgaggatgttataagtcagcagttaacccataaagataagaaaataaggatggaagcacatgccaagtttgcagttctttggcatctaacgagagatctccatataaataaatcttcatcttttgtacgttcttttgacaggtcactgttcatcatgttagatagccttaacagtctcgatggttctactagctctgtgggacaagcctggctgaaccaagtcctacaaagacatgatattgcacgagttttggaaccattgctattgctcctgcttcatccaaaaactcagagggtttcagtacagcgtgtacaagcagaacgttattggaataagtctccctgttatccaggagaggagagtgacaagcatttcatgcaaaattttgcctgcagcaatgtgagccaagtacaactcatcacatcaaaaggaaatggtgaaaagccacttaccatggatgaaatagagaactttagtctcactgtgaatccattaagtgacagactttccctcctaagtaccagcagtgagacaattccaatggttgtgtctgattttgatcttccagaccaacagatagaaatacttcagagttctgactcgggatgttcacagtcctctgctggggacaacttgagttacgaagttgatcctgaaaccgtgaatgcccaagaggattctcaaatgcccaaggaaagctccccagatgatgatgttcaacaggtagtatttgacctgatatgtaaagttgtaagtggcctcgaagtggaatctgcatcagttacatctcaattagaaattgaagctatgcccccaaagtgcagtgatatagatccagatgaagagacgattaaaattgaagatgactccattcaacagagtcagaatgctttgctgagtaatgaaagttctcagtttctgtctgtgtctgcagagggaggccatgagtgtgtggcaaatggaatctccaggaatagctcctcaccttgtatttcaggaaccacacacactcttcatgactcttctgttgcttccatagaaaccaaatctagacaaaggagtcacagtagtattcaattcagcttcaaagaaaaattatcagaaaaagtttcggagaaggaaacaatagttaaggagtcaggtaaacaaccaggagcaaaacctaaagtaaaacttgccagaaaaaaggatgatgacaagaaaaaatcttcaaatgaaaaactcaaacaaaccagtgtattcttcagtgatggtctggatttagagaactggtatagctgtggagagggagacatttctgaaattgagagtgacatgggttctccaggatctcgaaaatctcccaatttcaacattcatcctctctatcaacatgtgctcctgtatctccagttgtatgattcatccaggactttgtatgctttctctgccatcaaagccatcttgaaaactaaccctatagcttttgtaaatgccatttcaactactagtgtaaataatgcatatactcctcagttgtctctccttcagaatctattggccagacaccggatttctgttatgggcaaagatttttatagtcacattccagtggactcaaatcataacttccggagttctatgtacatagaaattcttatttctctctgcttatattacatgcgtagccattacccaactcatgtcaaggttactgcacaagatttaataggcaatcgaaacatgcaaatgatgagcatagaaattctgacactactcttcactgagctggcaaaagtaatagaaagctcagcgaagggtttccctagttttatttctgatatgttatctaagtgcaaagttcagaaagtgattcttcattgtttgctgtcatctatctttagtgctcagaaatggcatagtgaaaaaatggcaggtaagaacctggttgctgtggaagaaggtttctcagaggacagccttattaatttctcagaggatgaatttgacaatggcagcacgttgcagtcacaacttcttaaggtgcttcagaggctgattgttctagaacacagagtaatgactattcctgaagagaatgaaacaggttttgattttgttgtatctgacttagaacacatcagtccccatcaacccatgacttctcttcagtatttgcatgctcagccaatcacatgtcaaggcatgttcctctgtgcagtgatacgagctttgcatcagcactgtgcatgtaagatgcacccacaatggattggtttaatcacatctactctgccttacatgggaaaagttctgcagagagtggttgtttctgtgacactacaactgtgcagaaatttagataatctaattcagcagtacaaatacgaaacaggattatctgatagtaggcctctgtggatggcatcaattattccaccagatatgattcttactcttttggaagggattacagccattatccattactgtttgttggatccaactacacagtatcaccaacttttggtcagtgtagaccagaaacacttgtttgaagcacgcagtggaatcctctcaatccttcatatgatcatgtcctctgtgacactgctttggagcatactgcatcaagctgattcttcagaaaagatgactattgccgcatccgcatctcttaccactattaatcttggagctacaaagaacttgagacaacagattcttgaattgttgggccccatttcaatgaatcatggtgttcactttatggctgccattgcatttgtgtggaatgaaagaagacagaataaaacaaccaccaggaccaaggtcattcctgcagccagtgaagaacagcttttattagtggaattggttcgttcaatcagtgtcatgagagcagaaactgttatccagactgtaaaagaagttttaaagcagccaccagccatagccaaggacaagaaacatctttctttggaagtctgcatgcttcagtttttctatgcttatattcaaagaattccagtgcccaatttagtggatagctgggcgtcactgttgatacttctgaaagactctatacaactgagtcttccagctccagggcagtttcttatacttggggttctgaatgagtttattatgaaaaaccctagtttggaaaataaaaaagaccaaagagaccttcaggatgtaactcacaaaatagtggatgcaattggtgcaattgctggttcttctctggaacagacaacatggctgcgacgaaatcttgaagttaagccttctcccaaaataatggtagatggaaccaatttggaatctgatgttgaagatatgttatcacctgcaatggaaaccgcaaacataactccttctgtatatagtgtccatgcattgacattactctctgaggttttggctcatcttttggatatggttttctatagtgatgaaaaggagcgggttattcctttacttgtaaatattatgcattatgttgtgccctacctcagaaatcacagtgcacataatgcccctagttatcgagcttgtgtccagctgctcagcagtcttagtgggtatcagtacacacggagagcttggaaaaaagaagcttttgacctctttatggatcccagtttctttcagatggatgcctcttgtgttaatcattggagagcaattatggacaatctgatgacacatgataaaacaacatttagagatttgatgactcgtgtagcagtggctcaaagcagttcacttaatctctttgcaaaccgtgatgtggagctagaacagagagctatgcttcttaaaagattagcatttgctatttttagcagtgaaattgaccagtaccagaaatatcttccagatatacaagagagattggttgagagtctccgtttgccacaggtgccaactctccattctcaagtgttcctgtttttcagagtgttacttttaagaatgtctccccaacatcttacctcactctggcctaccatgattacagaacttgtacaagtatttttactgatggagcaggaactcactgctgatgaagatatttcacggacttcagggccctctgtggctggtctggagacaacgtacacaggaggtaatggcttctctacttcatataacagccagcggtggttaaacctctatctctctgcttgcaaatttttggatttggctctcgcattgccctctgaaaaccttcctcagtttcagatgtaccgatgggcctttattccagaagcctcagatgattcaggtttggaagtcagaaggcagggtatacatcaacgagaatttaaaccttacgtggtacgactagcaaaacttcttcggaaaagagcaaaggacaaggaggaggactttaagacagtgattttggagggattggagatggccaagcatcagaaaaatccagaggaagacaactcagggagaacattgggttgggagccagggcacttgctgctcaccatctgcaccgtgcgcagtatggagcagctcctgccgttcttcaatgtgctcagtcaagtcttcaacagcaaagtcacaagccgatgtggaggacactcagggagtcctatcctctactcaaatgccttccctaataaggacatgaaactggagaaccacaaaccatgttccagcaaagccaggcaaaaaatagaagagatggtagaaaaagattttctggaagggatgataaaaacttgagcaccattgctggttccatttagcttacatgtaaatgtaattatttaaaacacacacactgctctgcgttgtatagtttttccttttttgtatgtaacagaacacatttcagattgtatttaatttaaatatttgtatataagagcaaatgtctgaatgtggcctgaatcaagtttaaatattgttggctcatactgattatggtgcctaagagagctatatatatacacatgtaaagtccattgtttttattgtcctgagttgtcttaaacctgcaaaatatacactacccattttttttttc

SEQ ID NO: 127919 - DNA, 7743 bp, Homo sapiens
  Payload ID: 5045
  Gene Symbol: DOPEY1
  Gene Name: dopey family member 1
  ENST ID: ENST00000369739
  CDS Start-End: 149-7579
aggaaggaacacacaagtagttatctttcaggctgtctttgaatacttccatgaccctgaacactagctgaggagagtttcaaccactgctaacagtaatgactttacatgagtttggaactggtctctagtgggaagttgtgggaggatgaacacagaagagctggagttattgagtgactccaaatacagaaactatgtagcagcaattgacaaagcactaaagaattttgaatactccagtgaatgggcagatttgatatcagcacttggaaaacttaataaggttttacaaaataatgcaaagtaccaagtagtacccaaaaagctgaccataggcaaacgcctagctcaatgtctacatccagcattaccaggtggagttcatcggaaggcgcttgaaacatatgaaattatcttcaaaataattggacctaagcgacttgccaaagatctttttttatatagttctggattatttcctcttcttgcaaatgctgccatgtctgtgaaaccaacattgctcagtttgtatgagatatattatctgcctttgggtaaaacactgaaacctggtctacagggattgcttactggtattcttcctggcttagaagaaggatcagagtactatgagagaacaaatatgttgttggaaaaggttgctgctgctgtggaccagtcagcattctacagtgccctgtggggtagtcttctcaccagtcctgctgtgcgtttacctggaatcacgtatgttcttgcccatttaaacaggaagctttctatggaagatcaactttatataattggcagtgatattgagctaatggtagaagcagtaagtacttcagtgcaggactcaagtgtacttgtacagagaagcacactggacctcatactcttctgttttccattccacatgagtcaggccactcgaccggatatgatcaggatcttgtcagcagcccttcatgtagtgctaaggagggatatgtctctgaatcgaagactttatgcatggcttcttggacccagaagcacaagacacagtaatcctgaagaacatgccacttactatttcactaccttttcaaaagaattattagtccaggcaatggtgggaatcttacaagtgaatggatttggagaagagaacactctaatgcaggatctaaagccttttcgcattttaatcagtttactggacaaacctgagctaggacctgtaattctagaagatgtcctgattgaagtgtttagaacattatattctcaatgcaaagcagagttggatcttcaaactgaaccacccttcagcaaggatcatgctcagttaagcagtaaattaagagaaaataagaaaacagcagagctgattaaaactgctaaccttctctttaattccttcgaaccttattatatgtgggattatgttgcacgctggtttgaagaatgttgtaggaggacactgcatgtgagacttcagattggacctggagatagtaatgactcatctgaattacagctgaccaatttctgcttactggtggattttttgttggacatagtttctttgcctactagaagtatgagggtgctgtgtcaggagacttacattgaaatccagacagaacacttgccccagttgctgctcagaatgatttctgccttgacaagccatctccagacattgcacttatctgaactcacagattctctcagactctgctcaaagatccttagcaaggttcagcctccactgttatctgctagcactggaggtgttttgcagtttccaagtgggcagaacaattcagtcaaagagtgggaagacaaaaaggtatcatcagtttctcatgaaaatcctactgaagtgtttgaagatggagaaaatccaccaagtagtcgatcatcagagagtggattcactgagtttatacaatatcaagcagaccgaactgatgatattgacagagaactgagtgagggccagggggcagctgccatcccaattggtagcacatcctctgagacagaaacagcatccactgtgggatctgaagaaaccatcatccagaccccttccgtagtcactcaggggacagcaacccgaagtaggaagacagcccaaaagactgcaatgcagtgctgcttggagtatgtccaacagtttcttaccagacttatcaacctctacatcattcagaataactctttttctcagtctttggctacagaacatcaaggggatcttggtcgagaacaaggagagacttcaaaatgggacagaaattcacaaggagatgtaaaagagaaaaacataagtaaacaaaaaacttctaaagaatacctgtctgccttccttgctgcctgtcagctcttcctagagtgctcaagtttcccagtttacattgctgaggggaaccatacatcagagttacgttctgaaaaattggagactgactgtgagcatgtgcagcctccacagtggctccagactctgatgaatgcttgcagccaagcaagtgatttcagtgttcagagtgttgctatttcactagttatggacctggtgggactgacacagtctgtggccatggtcactggggaaaacatcaacagtgtagagcctgcacaacccttaagtccaaaccagggaagagtagctgtggttattagacctcccctcactcagggcaatctgaggtacatagctgagaagactgaatttttcaagcatgtagctttaacattgtgggaccagttgggagatgggacacctcagcatcaccagaagagtgtggaactattttatcaattacataacttagttccttcttctagcatctgtgaggatgttataagtcagcagttaacccataaagataagaaaataaggatggaagcacatgccaagtttgcagttctttggcatctaacgagagatctccatataaataaatcttcatcttttgtacgttcttttgacaggtcactgttcatcatgttagatagccttaacagtctcgatggttctactagctctgtgggacaagcctggctgaaccaagtcctacaaagacatgatattgcacgagttttggaaccattgctattgctcctgcttcatccaaaaactcagagggtttcagtacagcgtgtacaagcagaacgttattggaataagtctccctgttatccaggagaggagagtgacaagcatttcatgcaaaattttgcctgcagcaatgtgagccaagtacaactcatcacatcaaaaggaaatggtgaaaagccacttaccatggatgaaatagagaactttagtctcactgtgaatccattaagtgacagactttccctcctaagtaccagcagtgagacaattccaatggttgtgtctgattttgatcttccagaccaacagatagaaatacttcagagttctgactcgggatgttcacagtcctctgctggggacaacttgagttacgaagttgatcctgaaaccgtgaatgcccaagaggattctcaaatgcccaaggaaagctccccagatgatgatgttcaacaggtagtatttgacctgatatgtaaagttgtaagtggcctcgaagtggaatctgcatcagttacatctcaattagaaattgaagctatgcccccaaagtgcagtgatatagatccagatgaagagacgattaaaattgaagatgactccattcaacagagtcagaatgctttgctgagtaatgaaagttctcagtttctgtctgtgtctgcagagggaggccatgagtgtgtggcaaatggaatctccaggaatagctcctcaccttgtatttcaggaaccacacacactcttcatgactcttctgttgcttccatagaaaccaaatctagacaaaggagtcacagtagtattcaattcagcttcaaagaaaaattatcagaaaaagtttcggagaaggaaacaatagttaaggagtcaggtaaacaaccaggagcaaaacctaaagtaaaacttgccagaaaaaaggatgatgacaagaaaaaatcttcaaatgaaaaactcaaacaaaccagtgtattcttcagtgatggtctggatttagagaactggtatagctgtggagagggagacatttctgaaattgagagtgacatgggttctccaggatctcgaaaatctcccaatttcaacattcatcctctctatcaacatgtgctcctgtatctccagttgtatgattcatccaggactttgtatgctttctctgccatcaaagccatcttgaaaactaaccctatagcttttgtaaatgccatttcaactactagtgtaaataatgcatatactcctcagttgtctctccttcagaatctattggccagacaccggatttctgttatgggcaaagatttttatagtcacattccagtggactcaaatcataacttccggagttctatgtacatagaaattcttatttctctctgcttatattacatgcgtagccattacccaactcatgtcaaggttactgcacaagatttaataggcaatcgaaacatgcaaatgatgagcatagaaattctgacactactcttcactgagctggcaaaagtaatagaaagctcagcgaagggtttccctagttttatttctgatatgttatctaagtgcaaagttcagaaagtgattcttcattgtttgctgtcatctatctttagtgctcagaaatggcatagtgaaaaaatggcaggtaagaacctggttgctgtggaagaaggtttctcagaggacagccttattaatttctcagaggatgaatttgacaatggcagcacgttgcagtcacaacttcttaaggtgcttcagaggctgattgttctagaacacagagtaatgactattcctgaagagaatgaaacaggttttgattttgttgtatctgacttagaacacatcagtccccatcaacccatgacttctcttcagtatttgcatgctcagccaatcacatgtcaaggcatgttcctctgtgcagtgatacgagctttgcatcagcactgtgcatgtaagatgcacccacaatggattggtttaatcacatctactctgccttacatgggaaaagttctgcagagagtggttgtttctgtgacactacaactgtgcagaaatttagataatctaattcagcagtacaaatacgaaacaggattatctgatagtaggcctctgtggatggcatcaattattccaccagatatgattcttactcttttggaagggattacagccattatccattactgtttgttggatccaactacacagtatcaccaacttttggtcagtgtagaccagaaacacttgtttgaagcacgcagtggaatcctctcaatccttcatatgatcatgtcctctgtgacactgctttggagcatactgcatcaagctgattcttcagaaaagatgactattgccgcatccgcatctcttaccactattaatcttggagctacaaagaacttgagacaacagattcttgaattgttgggccccatttcaatgaatcatggtgttcactttatggctgccattgcatttgtgtggaatgaaagaagacagaataaaacaaccaccaggaccaaggtcattcctgcagccagtgaagaacagcttttattagtggaattggttcgttcaatcagtgtcatgagagcagaaactgttatccagactgtaaaagaagttttaaagcagccaccagccatagccaaggacaagaaacatctttctttggaagtctgcatgcttcagtttttctatgcttatattcaaagaattccagtgcccaatttagtggatagctgggcgtcactgttgatacttctgaaagactctatacaactgagtcttccagctccagggcagtttcttatacttggggttctgaatgagtttattatgaaaaaccctagtttggaaaataaaaaagaccaaagagaccttcaggatgtaactcacaaaatagtggatgcaattggtgcaattgctggttcttctctggaacagacaacatggctgcgacgaaatcttgaagttaagccttctcccaaaataatggtagatggaaccaatttggaatctgatgttgaagatatgttatcacctgcaatggaaaccgcaaacataactccttctgtatatagtgtccatgcattgacattactctctgaggttttggctcatcttttggatatggttttctatagtgatgaaaaggagcgggttattcctttacttgtaaatattatgcattatgttgtgccctacctcagaaatcacagtgcacataatgcccctagttatcgagcttgtgtccagctgctcagcagtcttagtgggtatcagtacacacggagagcttggaaaaaagaagcttttgacctctttatggatcccagtttctttcagatggatgcctcttgtgttaatcattggagagcaattatggacaatctgatgacacatgataaaacaacatttagagatttgatgactcgtgtagcagtggctcaaagcagttcacttaatctctttgcaaaccgtgatgtggagctagaacagagagctatgcttcttaaaagattagcatttgctatttttagcagtgaaattgaccagtaccagaaatatcttccagatatacaagagagattggttgagagtctccgtttgccacaggtgccaactctccattctcaagtgttcctgtttttcagagtgttacttttaagaatgtctccccaacatcttacctcactctggcctaccatgattacagaacttgtacaagtatttttactgatggagcaggaactcactgctgatgaagatatttcacggacttcagggccctctgtggctggtctggagacaacgtacacaggaggtaatggcttctctacttcatataacagccagcggtggttaaacctctatctctctgcttgcaaatttttggatttggctctcgcattgccctctgaaaaccttcctcagtttcagatgtaccgatgggcctttattccagaagcctcagatgattcaggtttggaagtcagaaggcagggtatacatcaacgagaatttaaaccttacgtggtacgactagcaaaacttcttcggaaaagagcaaaggacaaggaggaggactttaagacagtgattttggagggattggagatggccaagcatcagaaaaatccagaggaagacaactcagggagaacattgggttgggagccagggcacttgctgctcaccatctgcaccgtgcgcagtatggagcagctcctgccgttcttcaatgtgctcagtcaagtcttcaacagcaaagtcacaagccgatgtggaggacactcagggagtcctatcctctactcaaatgccttccctaataaggacatgaaactggagaaccacaaaccatgttccagcaaagccaggcaaaaaatagaagagatggtagaaaaagattttctggaagggatgataaaaacttgagcaccattgctggttccatttagcttacatgtaaatgtaattatttaaaacacacacactgctctgcgttgtatagtttttccttttttgtatgtaacagaacacatttcagattgtatttaatttaaatatttgtatataagagcaaatgtctgaatgtggcc

SEQ ID NO: 127920 - DNA, 511 bp, Homo sapiens
  Payload ID: 5045
  Gene Symbol: DOPEY1
  Gene Name: dopey family member 1
  ENST ID: ENST00000604380
  CDS Start-End: 1-511
taaattaagagaaaataagaaaacagcagagctgattaaaactgctaaccttctctttaattccttcgaaccttattatatgtgggattatgttgcacgctggtttgaagaatgttgtaggaggacactgcatgtgagacttcagattggacctggagatagtaatgactcatctgaattacagctgaccaatttctgcttactggtggattttttgttggacatagtttctttggagacttacattgaaatccagacagaacacttgccccagttgctgctcagaatgatttctgccttgacaagccatctccagacattgcacttatctgaactcacagattctctcagactctgctcaaagatccttagcaaggttcagcctccactgttatctgctagcactggaggtgttttgcagtttccaagtgggcagaacaattcagtcaaagagtgggaagacaaaaaggtatcatcagtttctcatgaaaatcctactgaagtgtttgaa

SEQ ID NO: 127921 - DNA, 623 bp, Homo sapiens
  Payload ID: 5046
  Gene Symbol: DOPEY2
  Gene Name: dopey family member 2
  ENST ID: ENST00000270190
  CDS Start-End: 189-623
gacccgcgcggtggggaagagccgctgccgctggttctccggctcttcctcggcggttctggctcccggccgcgccgcagccctgcccagtctctctcccccagcccggagggctcctccgcgccgcacgtgagcgcgcccgccaacagggccactgccgcgatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacagctgcgggttatttcctctcctggcacacgcggcggtgtcggtgaggccggtgctgctcaccctgtacgagaagtacttcctcccactgcagaagctgctcctgcccagtctgcag

SEQ ID NO: 127922 - DNA, 7685 bp, Homo sapiens
  Payload ID: 5046
  Gene Symbol: DOPEY2
  Gene Name: dopey family member 2
  Uniprot ID: Q9Y3R5
  ENST ID: ENST00000399151
  CDS Start-End: 86-6982
ttcatctcccacagtgcctggcccagaagccttgctaaatatttgaacaggattgcccaatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacagctgcgggttatttcctctcctggcacacgcggcggtgtcggtgaggccggtgctgctcaccctgtacgagaagtacttcctcccactgcagaagctgctcctgcccagtctgcaggccttcatcgtgggcctgctgcccggccttgaagagggctccgagatctccgacagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgaagtctttgcgtgcctccctgttggactcaaatgttcttgtgcaaagaaataatctggaaatcgttctgtttttcttcccattttatacctgtctggattccaatgagagagccatccccctcctcagatctgacatcgtgcgcattctctcagccgccacccagaccctactgagaagggacatgtccctgaacagaagactgtatgcatggttactaggctcagacataaaaggaaataccgttgtgccagaatctgaaatctcaaattcttatgaagaccagtcgtcttatttttttgaaaaatactccaaggatcttttagttgagggtttggctgagatattgcatcagaagttcatagatgctgacgtggaggaacgccatcatgcatacctgaagccttttcgcgtcctcatcagtctgcttgacaagccagaaatagggcctcaagtggttgggaatttgtttctcgaagtcatcagggccttttattcttactgcagagatgcccttggctctgatcttaaacttagctacacccagagtggaaattcgctgataagtgcaatcaaggaaaacagaaatgcctctgagattgtcaaaacggtaaatttgctgataacttctctaagcacagactttctctgggattatatgacaaggtgttttgaggaatgctttagaccagtgaagcagcgttacagcgtgaggaacagcgtcagccctccccccacggtctcggagctctgcgccctcctggtcttcctgctggatgtcattcctttggaactttactctgaggtgcaaacccagtatctccctcaggtgctcggctgcctggtgcagcctcttgctgaggacatggaggccttaagtttacctgaactcacgcatgccttgaagacgtgtttcaaggtgctcagcaaagtccagatgcctccttcctacctcgacacggagtccaccagcggaacctcgagtccagtaaaaggtgaaaacggcaaaataattttggaaacaaaggcagtgattcccggtgacgaagatgcttcgtttccccctctgaagtctgaggacagtgggatcgggctcagtgcctcgtcaccggagctctctgagcacttgagggttcctcgagtttctctggaaagggacgacgtttggaagaagggcgggagcatgcagaggacgtttctttgcatccaagagctaatcgccaactttgccagcaagaacatttttggagtacagctgacagcgtcaggagaagaaagcaagtccgaggagcctgcagggaagagggacagggatgggacgcagagcctggcagccaatgattccagcaggaagaactcttgggagcccaagcccatcactgtgcctcagttcaagcagatgctgtcagacttgttcacagcacgagggtctccattcaagacaaaaagttcagagtcaccatcgtcttcgcccagcagccctgccaggaaaaacgggggagaatgggatgttgagaaggtggtcattgacctggggggttccagggaggaacgcagggaggcctttgccgccgcctgccacctgctgctggattgtgccactttccctgtctacctgtccgaggaagagaccgagcagctctgtgcaacgctcttccagctgccaggagccggtgattccagttttccatcttggctgaagtccctcatgactatttgctgctgtgtgactgactgctacctccagaacgtggccatttccactctgctggaagtgataaaccattcccagtccctggcgcttgtcattgaagacaagatgaaacgctataagagctctggacacaaccctttttttggcaagctgcagatggtgacggttcctcccattgctccagggatattgaaagtcattgcagagaaaacagatttctatcagagggtggctcgtgtgctttggaatcagctgaacaaagagacccgggagcatcacgtcacctgcgtagaattgttctaccggctgcactgcctggcccctacggccaacatctgcgaggacatcatctgccatgccctcctggaccctgacaagggaacaaggctggaagctctgtttagattttccgtgatctggcatctgacaagagagatccaaggcagtcgagtaacatctcacaatcgctcctttgataggtccttgtttgtcgtgctggacagcctggcctgcacggatggtgccatcggtgcggcagcccagggctggctggtgcgtgcgctctccctcggggacgtggctcgcatcctcgaacccgtgctcctgctgctgctgcagccaaaaacccagagaacctccatccactgcctcaagcaggagaactcggccgatgacttgcaccgttggtttaacaggaagaaaacctctttcagagaggcatgcgcagtgcccgagcctcaggagagcggctctgaagagcacctgcctctgagccagttcaccacagtggaccgtgaagccatttgggccgaagtggagaaggagcccgagaagtacccgctgcgaggcgagctgagcgaggaagagctgccctactacgtggagcttccagacaggacggcccacggcgccccggacagcagcgagcacaccgagtctgcagatacaagctcctgccacacggacagcgagaacacgtcctccttctcctccccttcccacgacctgcaggagctgagcaacgaagagaactgctgtgcacccatccccatggggggcagggcgtaccccaagcgctcggccctgctggcggccttccagtcagaaagcttcaaggctggggccaagttaagcctggtgcgggtggactcggacaagacgcaggcttctgagtcgttctccagcgacgaggaggcggacttggagctccaggccctcaccacatccaggctgctaaagcagcagcgggaaaggcaggaggccgtcgaggccttgttcaagcacatcctgctctacctgcagccctacgactctcggcgggtcctctatgccttctcggtgctggaggctgtgctcaaaaccaaccctaaggaattcatcgaggctgtgtccaggactagcatggataccagctccaccgcgcacctcaacctcatctccaacctcctcgctcgccaccaggaggccctcattggccagagtttctacggaaagctccagacccaggtccccaacgtgtgcccccactctctgctcctggagctgctcacctacctctgcctgagcttcctgcgctcctactacccttgctatttgaaggtctcgcaccgagacattctcggcaaccgggacgtgcaggtcaaaagtgtcgaggttttgatcaggataatgatgcagctggtctcagtggccaagtcttcggaagggaagaacgtggagttcatccacagcttgctgcagaggtgcaaagttcaggagtttgtcctgctctccctgtcggcgtccatgtacacgagccagaagcgctacgggctggccaccgcccaccacggcagggccctgccagaggacagcctctttgaggagagtctcattaacttgggtcaggaccagatctggagtgagcacccgctgcagattgagctgctgaagctgctgcaggtgctgattgtcttggaacaccacctgggtcgggcccatgaggaggcggaaaaccagcccgacctgtcccgggagtggcagagagccctgaacttccagcaggccatcagcgccctgcagtacgtgcagccccaccccctcacctcccagggtcttctggtctctgcggtggtgaggggtctgcagcccgcctacggttacggcatgcatccggcctgggtgagcttggtcacgcattccttgccctacttcggaaagtccctgggctggacggtgacaccctttgttgtccagatttgcaaaaacttggatgacttggtcaagcagtatgaaagcgaatctgtgaagctctctgtcagcacaacctccaagagggaaaacatttctccagattatccactcacccttctagaaggtctaacgaccattagtcatttttgtcttttggaacaagccaaccaaaacaaaaagaccatggctgcaggtgatcctgccaacttgaggaatgccagaaatgccattttggaagagctgcctcgaactgttaacaccatggcccttctctggaatgttctcagaaaggaggagactcaaaagagacctgtcgatctcctaggggccacgaagggatcctcttccgtttactttaaaaccaccaaaaccataagacaaaaaattttagacttcttaaaccccttgacggcccatcttggggttcagttgacagcggctgttgcggcagtgtggagcagaaagaaagcccagcgtcacagtaagatgaagattatcccaacggcaagtgcatcccagctaacccttgtcgacttggtgtgtgcactcagcaccctgcagactgacacgctgctgcacctggtgaaggaggtggtgaagaggccaccccaagtcaaagggggtgatgagaaatcgcccctagtggacattcctgtgttgcagttttgctatgcttttctccaaaggctcccagtaccagccttgcaagagaacttttcttcactgttgggagtattgaaagagtctgtacagttgaatctagccccacctgggtattttctgcttctcagcatgctgaatgactttgtaacaagaactcccaacctggaaaacaagaaggaccaaaaagacctgcaggaaatcactcagaaaatcctagaagctgtggggaacattgccggctcttccttggagcaaaccagctggctaagcagaaacctggaagtgaaggcccaacctcaggcctctctagaagaatctgatgctgaggaggacctgtatgatgctgctgcagcttcagcaatggtgtcttcatccgccccgtcggtgtacagcgtgcaagccctctctctcctggcagaggtactggcttccctcctggacatggtttatcgaagtgatgagaaggagaaagctgtgccgttaatctcccgtctgctttactatgtttttccatacttacgcaaccacagtgcctacaatgctcccagcttccgggctggcgctcagctgctgagctccctgagtggctatgcctacacaaagcgagcctggaggaaggaggtcctggagctgtttctcgaccccgctttctttcagatggatacttcctgtgttcattggaagtccattattgaccatcttttgactcatgagaaaacaatgtttaaggatttaatgaacatgcagagcagttctttgaaactattctcaagttttgaacagaaagccatgctgttaaagcgccaggcttttgctgtcttcagtggagaacttgatcaataccacctttaccttccactgatacaagaacgcctgacagacaatctcagagttggacagacatccatagttgctgctcagatgtttctttttttcagagttttgctgctaagaatatctcctcaacatttgacttcattgtggccaataatggtctctgaattgattcagacattcacacagcttgaagaagatctaaaagatgaagatgagtcattgagaagcaccaacaaagtaaacagaacgaaagtttcagtcccggatgcaaatggaccctcagtgggggagataccccagagtgaactcatcttgtatttatcagcttgcaaattcttggacacagcgctttcttttccacctgacaagatgccattatttcaaatttataggtgggcatttattccagaagtggacacagagggccctgccttcctgtcggatgtagaggagaatcaccaagaatgcaaaccccacactgtcaggattctagaacttctaaaattaaagtttggggaaatcagtagctctgatgagatcaccatgaagagtgaattcccgcttctgcgccaacattctgtttccagcatcaggcagttgatgccattcttcatgactctaaatggtgcatttaagacccagagacagctgcctgctgatagcccaggaactccattcttggactttcctgtcacagatagcccaaggatcttaaaacaactggaagaatgcatcgaatatgattttctggaacatccagaatgttaaccatgtgagagagaatatgtttaatccatgtattggtactttactgaaaaccaggttatattctaaagaagaaagaaggcaggatagtgcttttgaacaagcctatttccattttgaaagtagatttcaggctaggtgcggtggctcacacctgtaatctcagcactttgggaggccaaggcaggcagatcacttgaggtcaggagttcgagaccagcctgaccaacatggtgagaccctgtctctactaaaaatacaaaaattagctgggtgtggtggcggcgcctgtaatcccagctacttgggaggctaaggcatgagaattgcttgaacccaggaggtggaggctgcagtgagccgagatcacgacactgcactccagctgtgtgacagaatgagaccatctccaaaaaaaaaaaaaagtagatttcagataatttactgttcagcaacaggacacacctccctaaatgccttgtaatatatttgaatctgattctgcatttcttcctcaatttatgtaatgaaaataaaattaatatatcatctaacagtagcacaaaatttgtaatatgaagtaaagtatgaagataatgaagaagttgttttctttgttgaagcagttatatgggtctttctcagtatatttctcttttctctaaaagtttaaacttattaaaagaatgttatttttaacctttca

SEQ ID NO: 127923 - DNA, 7346 bp, Homo sapiens
  Payload ID: 5047
  Gene Symbol: DRAXIN
  Gene Name: dorsal inhibitory axon guidance protein
  Uniprot ID: Q8NBI3
  ENST ID: ENST00000294485
  CDS Start-End: 136-1185
acatcctccggctgcccgcgcacctctccacgccggccccgttccgcggctcgccctcggctgcgctcggctcccgcgggcgctcggccccgagcccctcctccccctacccgccggccggacagggaggagccaatggctgggcctgccatccacaccgctcccatgctgttcctcgtcctcctgctgcccctggagctgagcctggcaggcgcccttgcacctgggacccctgcccggaacctccctgagaatcacattgacctcccaggcccagcgctgtggacgcctcaggccagccaccaccgccggcggggcccgggcaagaaggagtggggcccaggcctgcccagccaggcccaggatggggctgtggtcaccgccaccaggcaggcctccaggctgccagaggctgaggggctgctgcctgagcagagtcctgcaggcctgctgcaggacaaggacctgctcctgggactggcattgccctaccccgagaaggagaaccgacctccaggttgggagaggaccaggaaacgcagcagggagcacaagagacgcagggacaggttgaggctgcaccaaggccgagccttggtccgaggtcccagctccctgatgaagaaggcagagctctccgaagcccaggtgctggatgcagccatggaggaatcctccaccagcctggcgcccaccatgttctttctcaccacctttgaggcagcacctgccacagaagagtccctgatcctgcccgtcacctccctgcggccccagcaggcacagcccaggtctgacggggaggtgatgcccacgctggacatggccttgttcgactggaccgattatgaagacttaaaacctgatggttggccctctgcaaagaagaaagagaaacaccgcggtaaactctccagtgatggtaacgaaacatcaccagccgaaggggaaccatgcgaccatcaccaagactgcctgccagggacttgctgcgacctgcgggagcatctctgcacaccccacaaccgaggcctcaacaacaaatgcttcgatgactgcatgtgtgtggaagggctgcgctgctatgccaaattccaccggaaccgcagggttacacggaggaaagggcgctgtgtggagcccgagacggccaacggcgaccagggatccttcatcaacgtctagcggccccgcgggactggggactgagcccaggaggtttgcacaagccgggcgatttgtttgtaactagcagtgggagatcaagttggggaacagatggctgaggctgcagactcaggcccaggacactcaaccccaggaggggagccgctcggcgaatgagctgggtgggtgcccaggagccggcccgcagcacctgcacacacgaagtccggacccacgcagcctccatcccgcgtgtcttgctctccgcgatggcaatgccgagagtgccctctactgtccgactccagcactgcaacagcttcaagttcaaaaccaagaggcgtttttgagagtggaaaagaaatttaaacttcccgaaagaaggtccaccatcaggagatgaatatggaacatctcctatgtaccaggcactgtgctaagtgctggaatacattatctcattgaattatcacaacgaccttttcaagtaggcattatcaccatgcgacaggttgaggaccgtgaggcacgctggagttatttgactcgacttgcccagggtcccaggtcagtgctcctcaaacctgaacatgctaagagtcacctggaggtccagttaaaaatgtacatctggccgggcgcggcggctcacgcttgtaatcccagcactttgggaggccaaggcgggtggctcacctgaggtcaggagttcgagaccagcctggccaacatggggaaaccccgtctctattaaaaatacaaaaattaggccaggcgcggtggtgcacacctgtaatcccagctactcggaggctgaggcaccagaatcgcttgaacttgggaggcagaggttgcagtgagcagagatcgtgccactgcactccagcctgggggacaagagtgaaactccatctcaaaaaaaaaaaaaaaaaaaagcacatctgactcagtgggctctgtgctctaacaagctcccagggaacgcgaggctgctggcccagggacccactgagaggtcctgggaagtacatggcagagcaaggacatgaacctgggccaaggctgtccagctccaaggcccacgttcttgctgctccacagccaagaatttcttccagattctctaaggcttttggcaagagaggctcacaccctggtattcccttcctctgtggctggaataacttgactgttctctgccttccctggataaaggtgtatcatgtttaaaaacaaaacaaaatacaacttaagcacatacttgcttgcaggaataagttgggcaggttgatccctgtggtctagtagctgatatcctgggataagaagtgtttggggaaaagaatcatgttggcctttatgtccctgtggtcctgatcatccagtcctggacaggcactttacagttttctggagcacttcccccccaggggttctgatgcaagcatggaatccaaaaaaaccccacacatattgcccatgtttacccactttgcatactgtttagtgatttccaggaccacaaaaccatccctggaaccccaccccacatttttgcagcagagcccactgggaagttgaggctcacctgaaattgaggtgctatctgaagctaactgcccctaacaggccagactcacaatgcccacccaggacatctgtcccagcagatctggcttcaggggtcacttcaggagaaccatttaaatccccccacttggcatctcactcctggccaaccctctgttccagggcgaaccaggttgcaaatgacaaaagactttcctggccaaattcctcactggcctggatcacgcccataagatgccagagatgtttactgcgttggaaaaatcagtcggggtcaggggtcaggcaccaaggaaagcaggcagatctagaagaaattaaatatgcttgttctctccctatccaagtttgatgggcatgggaaccttgtggggagggagcagggagggcaggggaactgggagatcaaagcaggctagctgaaaggcagatatggctagacacaatggctcatgcctgtaatcccagcactttgggaggctgaggtgggcggaccacctcaggtcaggagtttgagaccagcctggccaacatggcaaaacccggtctctaccaaatatacaaaaattaaggctgggcacgagggctcatgtctgacatcccagcactctgggaggccgaggtaggcagatcacttgaagtaaggcgttcgagaacagcctgaccaacatggtgaaaccccatctctactaaaaatacaaaaattagccaggcatggtggcaggtgcctgtaatcccagctactcaggaggctcaggcgggagaatcacttgaacccaggaggcggaggttgcggtgagccaagatcacgccattgcactccagcctgggcgacagagtgagactccaaaaatataaaacacttaaaaatgtaaaaaggcagatctgccagcagcttcgtacttgagaccagacaacccacacatgctgtgtgtgcctcacattaagtggtgactcgggactgtgctggctctgtggggctagaaccctaaggagtaccgccggaagaaagcccagcattactatggctgggggacagctgttagatggtcctaggacatcagccatggagaacacagagggtcaggacaaagctaaaatgcccatagaactgccactggttgccagggtagttccatggttggaaattcaaggcccgtctctttgccctagctatctctatttgacatttccaaagagggatgggtggatggaacctcttaactccagagctgggaatcccaaagccctctcaagtgtctaaccaacctctctgccaggaagttcttccttaggtctatcttaaatttattttgctcatacagaagccagtttcctctaatccagggtttagcaaacttttactgtgaggagccaaataaacattttaggatttgcaagccatctgatctccaccagctactcagctctgccgtagctcgaagcagccacagagagtgtgtaaatgaattcatggctatgctccaggaaaactatttctggacacacatgtgaattctgtatacttttcacatgtcacaaaatattattctctctttccttttttttttttttggagatggagttttgctctgctgcccaggctggaatgcagtggctcagtctcagctcactgcaacctcttcatcccaggttcaagcaattctcctgcctcagcctcccaagtagctgtgactacaggcatgtgccaccacacctggttaatttttgtatttttagtagagataaggttttaccatgttggccaggctggtctcaaacttctgacctcaggtgatccgcccgcctcagcctcccaaaatgctgggattacaggtgtgagccaccgcacctggccataaaatattattagtttaattttctaaaaccatttaaaagtgcaaaaactgctctttgcttgccaactgcgcaaaaccaggcagtggggcagatttggcctgagggtcacggtttgccaacccctgctcaagcctgctcactctcaacgctggctgcacgttgcaataatccaggaacattcacaggcctggggcccacccacaaagcttctgttttgtttggtctgggcttcatagtttttctcccaggtaacttcaggtgcagctggggcggagagtctctgctctccccttccatctgtagcagtgtggctggtgttaaatccacctattccacctctcacagctttggcaaccttaggaaagtttcttaaggtctctgtgccttgattttttcatctgtaaaatgggaataataactctcccttcatagggttgttgtgagtagtgaatgcatacttctttttttttttttttcttttgagacagagtttcactcttgttgcccaggctggagtgcagtggcacgatctcggctcactgcgacctctgcctcctgggtacaagtgattctcccgcctcagcctctcgcgtacctgggattataggcaagcatcaccacgcccggttactgtttgtatttttagtagagatggggtttcaccatgttggccaggctggtctcaaactcctgacctcaggtgatccccccgtctcagcctcccaaagtgctgggattacaggcatgagccagcatgcctggcctgtgaacgcagaattcttataaggtgtttagaacagtgcctagcacctaataaacctccagtgttagctaatttgttattctaggagaattttagatgtcggttctttgacaatgacccatcacatactctgagatcatttctaagtcaccattcaagctccttccccaaagtgtgttccatagaacactgggaccatgagatgctctattagaaagggtcagggtacggttccatggtcagagaggtttggaaaactgttctggcctcagcccttggcagcatgtgcagattccaggcaccgaggcagggctggaggagtaagtggctttgcaataaaatgggtgctggagtctaaaatgataccctgggtggagtgggggagctgagcaggaggccaggtggcaaccagtagctgctgggcccgtggcctgaaccctcctgcactcctccagctggagtctcaccgcggatcccaggaatacctgctgttcccacagggctgcctttccgtagtttgtctggagacaccaagagtggtttccatgcctgctgggaataggctgagcatgcaatgacatgagggccaaggcttgtgggaaaatgacagcttcacagccccttgaggagtgaccaagccacaaagtaaatcctaaagccacaaccccttctaccactgagctgctggaggtgggtccttatttcaagccatattcaacccacccaacaaaacctaacattgaggtggtgggcacacggcccctgccgtggggctcactctgcagctggagagacagcatacctgaaacctgcaaggaaccggtttataaaacaacagaacagccaggaaaatggtgctaggagagacagtggagaggccagagaagcaaaccactgtggctcctcactgggggtttcacggggttggactgagccctgtcacctctgtgatagtcttcactctgacaggcaatggtgactgtgtgtgtttcctggggaggaggttagcagggacggttgcctttcctgggaagggcagtttgcagaaccaggggtttatattgcagggagtgtattttctgaattctaagtcagaacaagcagtctgatacaggatccatggctgggtcacttctgggtgcaagaggctttctagaccttagacactcaagattacggtcccgggccagtaacagcacctgggagcttggtagaaatgcagaatcttagcctaggcaacatagggagacctcatctctgcaaaaaataacaaaattagccgggcatggtggtgcacacctgtagtcccagctattctccaggctgaggtgggaggatcgcttgagcccaagaggttgaggctgcagtgagccatgatcgcaccactgcactccagcttaggcaatacagcgagaccttgtctcaaaaaaagacaaaaaaaacaaaaagaaatgtagattcttgggccccaccaccccacgcctactgagccagaatctctgggggtggggcccagccatttggcttttcacaagttctccaggtcattcttgggcacgatcaaatttgagaatcacaggtctaggatacgacggggaaaacagaaatgtggggtggtcagggacattcggataattcgggctatttgtattcaggtgtgagctggcaaatccgagacctgttttgcgtagctaattaccagcaatgacaaactcccaggctctgaggcccaagcctcctgggctgcaactggtctttatttttggaggcaatgaatggagcacctcggcctgggaccctcagtgtagggttttctgactcttaggcaacttcctagggtgctgtacttcctttttaaagttggggagcggcagggggagggggaagtgccacgcccttgtagtttcatgatgtcatgttgcatgtgctcttgagctgtaaataaagagacgatggttaaaaagcc

SEQ ID NO: 127924 - DNA, 2738 bp, Homo sapiens
  Payload ID: 5048
  Gene Symbol: DRGX
  Gene Name: dorsal root ganglia homeobox
  Uniprot ID: A6NNA5
  ENST ID: ENST00000374139
  CDS Start-End: 12-803
gacagccggcgatgttttatttccactgcccgccacagctagagggcactgcaacctttggcaatcactcttcgggggattttgatgacgggtttctgcgtagaaaacagcgccggaaccggacgacgttcactcttcagcagctggaagctctcgaggccgtttttgcccaaacacactatccagatgtcttcaccagagaagagctcgccatgaaaataaacctcacagaagccagagtgcaggtttggttccagaacagaagggccaaatggaggaagacagagagaggggcctcagaccaggagccaggagccaaggagcccatggcagaggtgacacctcctccagtgagaaacatcaactccccgccccctggggaccaagcccggagtaagaaggaggcgctggaggcccagcagagcctggggcgaacggtaggtcctgcagggcctttcttcccctcctgcttgccggggactctcctgaacacggccacctacgcccaggccttgtcccatgtggcttccctcaaagggggcccactgtgctcttgctgcgtcccagaccccatgggactctccttccttcccacctatggctgccagagtaaccgcacggccagcgtggccaccctgcgcatgaaggcccgcgagcactcagaagctgtcctgcagtcagccaacctcctgccttccaccagcagcagccccggccctgtcgccaagccggcgcccccagatggcagccaggaaaagacctctcccaccaaggaacagagcgaggcagagaagagtgtatgagggtccacagtgccccgcccggcctgccctcccccgcccctccttctcccagcctcagcccctacagaaaactctccaaatagcaaggagaagcctgcggccccagggcctctgcatggacccaggacgggcaagtgagacccacagctcccttggcacctggagcgtccctctggagtcccaccagtgcggcagtgttgtcctggcttctttggcaacagatcccgatggcacttggtggcagcagagccctctctgtgaggagcctccctgggatttccatccaggcccagagtctcggagggaggtagattcctcatccgtctcccttcctatttcctccctgggctgcctttgaaggtcttgtcaaccccaggaactgtggcatgggctgaagtttcatgaaaagaaaagggcctgtcccgcttacagtgtttaagaactggggaactggtggaaccccaagcgactcttgctcccctggaccaagatgagcagtaatgccctttctcttgttggagaatattggttgtgggcttcattacaaagtgagaagatgcagggtagggaggggccaacaggacacagcctgtcccagaggaccacggtggctctgacccaggagatctcactggcacatctggccggggggctgggctaatcacccaggccacctgctccatgaactgggggctgctgtcttgacactgtgggtgtggaactagtgtggcccctgtacctgaagcactcacctgcaagcccttcctctctcccagatagacctgtggattggtgggaagttaagcaactgaaaagcagctctctggtccaggagggcctgagggcccttggagagggaagaagcccttcaggaatgcctctgaagtaattatgcatacagatgaactacctttccccacatgcctggcacgtagagggggctcttcagtggtggtggttttttactggggaaaaaaaagtaggaaaggagacaggaacggcgtatgtgcagatatggagcatggggaagacagctttctcatggtgtggagagcattaattccaaagggccaaatttcacagagatttctgttttggtctagtgtggctgttttctctggtgaggatggtgacctagaggagatccaaggggaacgtgcaatagcataagctctgccgctttctggcaggggcgcccggcatgggaaaggttgcagtctttggtggcttttgctgatggtgtttccatgcggatggttattgccttcatgatggttattttggtttcagttattatcgtcaaaatgttttactttcacatttcctgtcccctttttaccttcccccactccatgacccccaaataatactcctgagtgtatcatgccttgtctatgatcactacgaagcatttgataaaacccactgtctcctttaaagaaaaaaatcaaatccttcttcctgctgtattttgcttgttgagtataaagatgaaacgatttgccaaaaagcggcaaagttgcttccgtttccctgtaattacgaatgtttggttgaaggatgtaagctcaagcccttatgtacactaactcttcaatctaattgtttgattaaactcgtatttcctccagaaaggtacataaataagtgaactgttgagcaaattaagaatacttaacagcattgcatctgaaaagtagttatgctgattaaattttgtgtccttgaggactttcaggaaattacttttgatcgtcaataacacaattaagtaaactacacacacattagcatgaataattgataagaaattatgtattaccacgaagcactgatttaataattcatgatgcgacactctagtgactgtgcaaaactggatcatatcgaaaagtctgcctgatgttactgaaaggaaagaaaatgagcaccaaa

SEQ ID NO: 127925 - DNA, 955 bp, Homo sapiens
  Payload ID: 5048
  Gene Symbol: DRGX
  Gene Name: dorsal root ganglia homeobox
  Uniprot ID: A6NNA5
  ENST ID: ENST00000434016
  CDS Start-End: 164-955
gagccccgcccgccgccagccgagcagggcttgcggatcggaggcggtcacgctccgacctcctcgaccgccgcccgccgagccaggcaggagcaacgcgcgcgggtccgttctgctgccaccctcccaggtctcggccgtccagccgatctgacagccggcgatgttttatttccactgcccgccacagctagagggcactgcaacctttggcaatcactcttcgggggattttgatgacgggtttctgcgtagaaaacagcgccggaaccggacgacgttcactcttcagcagctggaagctctcgaggccgtttttgcccaaacacactatccagatgtcttcaccagagaagagctcgccatgaaaataaacctcacagaagccagagtgcaggtttggttccagaacagaagggccaaatggaggaagacagagagaggggcctcagaccaggagccaggagccaaggagcccatggcagaggtgacacctcctccagtgagaaacatcaactccccgccccctggggaccaagcccggagtaagaaggaggcgctggaggcccagcagagcctggggcgaacggtaggtcctgcagggcctttcttcccctcctgcttgccggggactctcctgaacacggccacctacgcccaggccttgtcccatgtggcttccctcaaagggggcccactgtgctcttgctgcgtcccagaccccatgggactctccttccttcccacctatggctgccagagtaaccgcacggccagcgtggccaccctgcgcatgaaggcccgcgagcactcagaagctgtcctgcagtcagccaacctcctgccttccaccagcagcagccccggccctgtcgccaagccggcgcccccagatggcagccaggaaaagacctctcccaccaaggaacagagcgaggcagagaagagtgtatga

SEQ ID NO: 127926 - DNA, 7436 bp, Homo sapiens
  Payload ID: 5049
  Gene Symbol: DOT1L
  Gene Name: DOT1-like histone H3K79 methyltransferase
  Uniprot ID: Q8TEK3
  ENST ID: ENST00000398665
  CDS Start-End: 37-4650
cccgcctagcatggtgcggcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggccacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaactgcactggatgccctgcacgctcagaccgtgtctcagacggcggcctcctcaccccaggatgcctacagatcccctcacagcccgttctaccagctacctccgagcgtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaacaattctgacttattttattccatctaagtggtaaaaggcaacttattgagaaatataaatatctatatatgagagctctatataaagacacgtgtctgcagggcgggcccgccagcggattcgccacagcctgccccggtgctatctcgtccccaggcccgcgcctgcctccacccgcttggtgctgactagacgctgacaacgccgaaccccgttctcggaaacgccgcccggccggctcccccgacgcgctgctcccgtaccaaaggcaggcccgtcgccaccacattcctcggaggcctccccgcggcctgagccccttcctgagcgccctggcgcctgccctgagctcttcacctttaccccggcactgtgaacccccagactgttcaccctccggggcgtgggttgcgcccttgcatgtgaaggggcctgcgcggtgacgcagctggccatgtgctgcgcgatggtgctgtgaggacggcgcgggcacgttgaacaagtgcatttacttttgtatttctcggctgtccatggctcgcagcatgccctgcgatgcggggcaggcctgtcgtgggtcccttggtgtttctgtacaggagagagtcacactaatgagtggcagtattttatagagatgtgatgagaatttataaatttcatagatttgacagcttttatttttagatggtataatgcacagtgaagaggaaagaaaagcgaggggaaaaaaccttatttattcaaacagtgcacaaaatggccccagcgtcagccccgaccctagacccctcagttgcagctcccagcagcccagacagagctgccggcgcccctgcctgccccacatcccttcctgtcagggccacgcctggcacccatcccttggagcctgtgctggttctcccagctgctgtgggtgtgctggggccagggtgcactgctgaaacctggcctctctggccctaggccccagggtgacgtcggccccccactctgcagccttggcgggtgcctgggactgggtgtggaaggagaggagctgaggccggggtgtagcaggcaggcagggccactccagtgcttctggagccctgagcagtcagggcctgggttgtctgagcagtggtggctctgtgccctccctggaggatgggatctgggagtctgagctccccgcatctggccctgggctgtgtggcacttgctgagcccaccttctcaagtgcttgctcctgtgagatggcatcggggagccccttccccaaggtgccacagatccaccctccagggagctgccagccctgtgttctggttcccaagggcaggatggacacacgtcacatccctaccacgtggcctccaaagggagccacggaggaaaggcttctgtggttgctaggtgggggagtcctgtgtgggagggcctgaagacccctgcttgtgcctggtgaggggggtgctgcctcccccagcccccaacaacctctcagacccccaccctccaacatagctgagttctgaagatggtgctccggacctgtcctcttaagtggtgcccagtgccctccccaccccacgttggtgctctcagctagaaggtgctgtgcctctgcctgagccccaagccccgagcctggccttcaggacaggcagcctgctctgtgtcgccacgggccggatacgccacagggttgatggcagagacggccgagtccctggtctagaacaagacacattctttaaacactgtattacttctgcctccctctaggtgacagtggcagtccgggtgccatcacgggtcctgcagatggccatgcagggctcctgcccacgcaggccaccgtatgttcaggacacgcactgggtctcagagccactggcccaggcagaagtctccttgagcccactgggtcatatgcgtgtcaccacacgtgaactagtgtggtggctgcctgcggacaccctcctgttctgagccctgggcctgtgttcttctcagacactcccagactgaggggtggtgtgtggcgggtggcagggtggctgtggagactggggatctggagcctggtgctggcacctggcctgagtttccgtgggcagctggcggggacctgtgctgctgctgctgactgtgggtgggcgggcggcgcctgggagtggctcttgctcaggaattgataggaaccctaaaaactaggataccccctcctcggcccatgaggcacgcacagtgacttatttaagacttcccccttaatttatctgcccccaggatgcgtcagtctgttcagtggtcagcaggccccccaccccccgccgactgccctcgccatcgtggtcagacccccctcccaacacaacacgctgctggtctgtgtcagcctttgtaacgtgggaggctctgccgtgtcttccgggtgaactgtatttggattgcgcgcattgtcacggtccgcccctgggctgcaggcgccccttcctctgggcacccctgcattctgcatccccacctctagacgctgtaataaacagactgttttcactcgga

SEQ ID NO: 127927 - DNA, 624 bp, Homo sapiens
  Payload ID: 5049
  Gene Symbol: DOT1L
  Gene Name: DOT1-like histone H3K79 methyltransferase
  ENST ID: ENST00000452696
  CDS Start-End: 1-624
atgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatc

SEQ ID NO: 127928 - DNA, 2907 bp, Homo sapiens
  Payload ID: 5049
  Gene Symbol: DOT1L
  Gene Name: DOT1-like histone H3K79 methyltransferase
  ENST ID: ENST00000457590
  CDS Start-End: 1-1962
tcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggagaaggccaccgtgcgcagggccaccagagcattactttctcccgtggaggtcacctgctaggtgtggccgcccgggctctggcaaggctctgggagctggtgttgggtgtctttaaccacgcggtgccctccgcctctgctcatccgtttggagcccgtgtcggccgcggggctgcatgtggcagcgccacactgggcccgagcccgctgcaggcggcggccagcgcctcggcctcttcctttcaggccccggcctcggttgagacccggccgccccctccgcctccgcctccgcctcccccgctgcccccgcctgcgcacctgggccggtcccccgcggggccgcccgtcctccacgccccccctccacctaacgccgccttgcctcctcccccaacgctgctggcctctaaccctgagcccgcgcttctgcagagcctcgcgtccctcccgcctaaccaagctttcttgccccccacctctgctgcctctctgccgcctgctaacgcctctttgtctatcaagctcacctccctcccgcacaagggcgcccgcccctccttcacggtgcaccaccagcccctgccccggctggccctggcccaggccgcgcccgggatcccacaggccagcgccacggggccgtccgcggtgtgggtgtccctcggcatgccgcctccctatgccgcgcacctttcgggggttaagccgcgataaagaccttgcttagctagcagtgcgtattgtgtaaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaacaattctgacttattttattccatctaagtggtaaaaggcaacttattgagaaatataaatatctatatatgagagctctatataaagacacgtgtctgcagggcgggcccgccagcggattcgccacagcctgccccggtgctatctcgtccccaggcccgcgcctgcctccacccgcttggtgctgactagacgctgacaacgccgaaccccgttctcggaaacgccgcccggccggctcccccgacgcgctgctcccgtaccaaaggcaggcccgtcgccaccacattcctcggaggcctccccgcggcctgagccccttcctgagcgccctggcgcctgccctgagctcttcacctttaccccggcactgtgaacccccagactgttcaccctccggggcgtgggttgcgcccttgcatgtgaaggggcctgcgcggtgacgcagctggccatgtgctgcgcgatggtgctgtgaggacggcgcgggcacgttgaacaagtgcatttacttttgtatttctcggctgtccatggctcgcagcatgccctgcgatgcggggcaggcctgtcgtgggtcccttggtgtttctgtacaggagagagtcacactaatgagtggcagtattttatagagatgtgatgagaatttataaatttcatagatttgaca

SEQ ID NO: 127929 - DNA, 376 bp, Homo sapiens
  Payload ID: 5049
  Gene Symbol: DOT1L
  Gene Name: DOT1-like histone H3K79 methyltransferase
  ENST ID: ENST00000446286
  CDS Start-End: 1-376
ggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtgtctttaaccacgcggtgccctccgcctctgctcatccgtttggagcccgtgtcggccgcggggctgcatgtggcagcgccacactgggcccgagcccgctgcaggcggcggccagcgcctcggcctcttcctttcaggccccggcctcggttgagacccggc

SEQ ID NO: 127930 - DNA, 725 bp, Homo sapiens
  Payload ID: 5049
  Gene Symbol: DOT1L
  Gene Name: DOT1-like histone H3K79 methyltransferase
  ENST ID: ENST00000586024
  CDS Start-End: 1-429
caggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagagccccatcccgtcgacactgtgcccgcctgctcaccttacgtgtccccagcgtggtttcactgttgatggacctggtgccctgtcgctggacctctgctgccttttcaaatgactgcaccaaaccgttgctgcaaggctgtccccggaggcgggctctcacgggcggctgacggacgtcgggaagcaccactcacgtgctcccgagctgctccctcacgtgtgtggcccaggcgagcctcaccagcgtacattagagaaacggaggtcgccgacctctttaccacagccgggccctgtgggtctgcctggagtagagccctcgggaagagcatatttgggttctgaccatttttgtcatcatcttttctgtgtaataaaaaaacaatgtgtttgttaaaagaaaggaaa

SEQ ID NO: 127931 - DNA, 638 bp, Homo sapiens
  Payload ID: 5049
  Gene Symbol: DOT1L
  Gene Name: DOT1-like histone H3K79 methyltransferase
  ENST ID: ENST00000478937
  CDS Start-End: 1-209
tggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagctgctggttaaggaaaacatgaacttggcctgtggagcactggttttcctatgaggaaggggaagtgtgaacctcggcacatgcagtgcccagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgagtgtcgcccgccatgcccggctcctgtgcacttccaggccacacgctctgtgcctgcccca

SEQ ID NO: 127932 - DNA, 2071 bp, Homo sapiens
  Payload ID: 5050
  Gene Symbol: DOC2A
  Gene Name: double C2-like domains, alpha
  Uniprot ID: Q14183
  ENST ID: ENST00000350119
  CDS Start-End: 192-1394
cgccgccgcgccggctgcatcctcgcctccacctcgctcaccccctcctccccgcactttctcggcgctccctccctctcggctcgcacagctcgactccgcgctctcctcgccggccgccgccgcccagcctgcgcccgccgtccccccagtgcctgggcacctgttggaggcagagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggggcggcggggaggcccccgcccatctggtccccctggctctggccccccctgcagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttcgcagaagaagcattttaacatctgcctcgagcgccaggtcccgctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtacctgaggcccgatgtggacaagaaatccaagcataagacgtgtgtgaagaagaagactctcaacccagaatttaacgaggagtttttctacgagatagagctctccactctggccaccaagaccctggaagtcaccgtctgggactatgacattggcaaatccaatgacttcattggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaaaaacaaacccagagccactcctttaatacagaaacttcattgaaaaaacctagccctgtacagctgcccttttaaagaggtggccattgcagggtctctgcctccccagcaggtggcagatgctcccggccactcgtttaaataactgtcccctggagggggccggggtttgaaggcagggcccctgccaccctcctgggggacacccgtgcatgtttacgccttttctggttgtgtcagtggccggagcatggcagctgggcatcaataaacacctccgaggaagctgg

SEQ ID NO: 127933 - DNA, 556 bp, Homo sapiens
  Payload ID: 5050
  Gene Symbol: DOC2A
  Gene Name: double C2-like domains, alpha
  ENST ID: ENST00000567332
  CDS Start-End: 316-556
agctcgactccgcgctctcctcgccggccgccgccgcccagcctgcgcccgccgtccccccagtgcctgggcacctgttggaggcagaggaagggaggccagtgagggccccacagaccgaggaggccgtcgcctggccctcagccaggatggctagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctcc

SEQ ID NO: 127934 - DNA, 1128 bp, Homo sapiens
  Payload ID: 5050
  Gene Symbol: DOC2A
  Gene Name: double C2-like domains, alpha
  Uniprot ID: Q14183
  ENST ID: ENST00000566310
  CDS Start-End: 284-775
gcactttctcggcgctccctccctctcggctcgcacagctcgactccgcgctctcctcgccggccgccgccgcccagcctgcgcccgccgtccccccagtgcctgggcacctgttggaggcagagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttcgcagaagaagcattttaacatctgcctcgagcgccaggtcccgctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtacctgaggcccgatgtggacaagaaatccaagcataagacgtgtgtgaagaagaagactctcaacccagaatttaacgaggagtttttctacgagatagagctctccactctggccaccaagaccctggaagtcaccgtctgggactatgacattggcaaatccaatgacttcattggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtg

SEQ ID NO: 127935 - DNA, 1782 bp, Homo sapiens
  Payload ID: 5050
  Gene Symbol: DOC2A
  Gene Name: double C2-like domains, alpha
  Uniprot ID: Q14183
  ENST ID: ENST00000564944
  CDS Start-End: 193-1395
gttggggaacacccggcgattctggcggctgcttcctggtggcgcagggagcccgcgtgtttgcgagtgcgtgtgtgtgcgaagttctccggctcgactccgcgctctcctcgccggccgccgccgcccagcctgcgcccgccgtccccccagtgcctgggcacctgttggaggcagaggcaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggggcggcggggaggcccccgcccatctggtccccctggctctggccccccctgcagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttcgcagaagaagcattttaacatctgcctcgagcgccaggtcccgctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtacctgaggcccgatgtggacaagaaatccaagcataagacgtgtgtgaagaagaagactctcaacccagaatttaacgaggagtttttctacgagatagagctctccactctggccaccaagaccctggaagtcaccgtctgggactatgacattggcaaatccaatgacttcattggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaa

SEQ ID NO: 127936 - DNA, 1630 bp, Homo sapiens
  Payload ID: 5050
  Gene Symbol: DOC2A
  Gene Name: double C2-like domains, alpha
  Uniprot ID: Q14183
  ENST ID: ENST00000564979
  CDS Start-End: 114-1316
tcctgacggcgctggagctgaggggcagtgcgggatgccccaggaaggctcctaggaagaggggacccacggtgacttcctaaggaagcgcggttcccagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggggcggcggggaggcccccgcccatctggtccccctggctctggccccccctgcagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttcgcagaagaagcattttaacatctgcctcgagcgccaggtcccgctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtacctgaggcccgatgtggacaagaaatccaagcataagacgtgtgtgaagaagaagactctcaacccagaatttaacgaggagtttttctacgagatagagctctccactctggccaccaagaccctggaagtcaccgtctgggactatgacattggcaaatccaatgacttcattggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccc

SEQ ID NO: 127937 - DNA, 843 bp, Homo sapiens
  Payload ID: 5050
  Gene Symbol: DOC2A
  Gene Name: double C2-like domains, alpha
  ENST ID: ENST00000563378
  CDS Start-End: 233-843
gggaggcactggcgaagcggtgctgagccgagtcctgacggcgctggagctgaggggcagtgcgggatgccccaggaaggctcctaggaagaggggacccacggtgacttcctaaggaagcgcggttcccagctcgactccgcgctctcctcgccggccgccgccgcccagcctgcgcccgccgtccccccagtgcctgggcacctgttggaggcagagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggggcggcggggaggcccccgcccatctggtccccctggctctggccccccctgcagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttc

SEQ ID NO: 127938 - DNA, 858 bp, Homo sapiens
  Payload ID: 5050
  Gene Symbol: DOC2A
  Gene Name: double C2-like domains, alpha
  ENST ID: ENST00000565273
  CDS Start-End: 205-858
ctccgcgctctcctcgccggccgccgccgcccagcctgcgcccgccgtccccccagtgcctgggcacctgttggaggcagaggcaggaagggaggccagtgagggccccacagaccgaggaggccgtcgcctggccctcagccaggatggctaggtatgatgggctcactggctcacacgccctctcctagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggggcggcggggaggcccccgcccatctggtccccctggctctggccccccctgcagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttcgcagaagaagcattttaacatctgcctcgagcgccaggtcccg

SEQ ID NO: 127939 - DNA, 562 bp, Homo sapiens
  Payload ID: 5050
  Gene Symbol: DOC2A
  Gene Name: double C2-like domains, alpha
  ENST ID: ENST00000563125
  CDS Start-End: 403-562
aagatgatacagggacaacctagaagtgggtgggtgaggacggggtggtgcaacctcgacttctgcaaggagtgggttggcagcccagcccctgtggagtcagcttggggtctgcagggcccaggcctcccacctgccaccggctggcacacaccaccctctccctcgacacctaggaagggaggccagtgagggccccacagaccgaggaggccgtcgcctggccctcagccaggatggctagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgc

SEQ ID NO: 127940 - DNA, 1097 bp, Homo sapiens
  Payload ID: 5050
  Gene Symbol: DOC2A
  Gene Name: double C2-like domains, alpha
  ENST ID: ENST00000561671
  CDS Start-End: 284-463
gcactttctcggcgctccctccctctcggctcgcacagctcgactccgcgctctcctcgccggccgccgccgcccagcctgcgcccgccgtccccccagtgcctgggcacctgttggaggcagagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggatcgccgtctgtgatgaggacaagctgagtcacaatgagtttattggggagatccgcgtgcccctccgccgcctcaagccttcgcagaagaagcattttaacatctgcctcgagcgccaggtcccgctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtacctgaggcccgatgtggacaagaaatccaagcataagacgtgtgtgaagaagaagactctcaacccagaatttaacgaggagtttttctacgagatagagctctccactctggccaccaagaccctggaagtcaccgtctgggactatgacattggcaaatccaatgacttcattggtgagggaggagctggctgcgggtgttgagggcgggcaagtggcagggaggtggccctgaccctgcccacctgctccccaggtggcgtgtccctggggccaggtgcccgaggcgaggct

SEQ ID NO: 127941 - DNA, 527 bp, Homo sapiens
  Payload ID: 5050
  Gene Symbol: DOC2A
  Gene Name: double C2-like domains, alpha
  ENST ID: ENST00000574405
  CDS Start-End: 489-527
aacgaaggtgcgtgctcagcggactctgcagacccagtgccgcgacttcccctaaagccaggcgtgtatctgcgcgtgtgaggtgctctgccgcaaccctatgcagagagcagggtctcactctgttacccaggctggagtgcagtggagtgattatagcttactgcagccttgaccttctgggctcaagagatcctcccaccatcacgaggtcaggagatcgagaccatcttggctaagaagctcgactccgcgctctcctcgccggccgccgccgcccagcctgcgcccgccgtccccccagtgcctgggcacctgttggaggcagagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctg

SEQ ID NO: 127942 - DNA, 2065 bp, Homo sapiens
  Payload ID: 5050
  Gene Symbol: DOC2A
  Gene Name: double C2-like domains, alpha
  Uniprot ID: Q14183
  ENST ID: ENST00000616445
  CDS Start-End: 193-1395
gttggggaacacccggcgattctggcggctgcttcctggtggcgcagggagcccgcgtgtttgcgagtgcgtgtgtgtgcgaagttctccggctcgactccgcgctctcctcgccggccgccgccgcccagcctgcgcccgccgtccccccagtgcctgggcacctgttggaggcagagccaggggtgctgcatgaggggccgcaggggcgatcgcatgaccatcaacatccaggagcacatggccatcaacgtgtgccccgggcccatccggcccatccgccagatctctgactacttcccccggggaccaggacctgaagggggcggcgggggcggcggggaggcccccgcccatctggtccccctggctctggccccccctgcagccctccttggggccaccacgcctgaggatggtgcggaggtggacagctatgactcggatgatgccaccgccctaggcacgctggagtttgaccttctctacgaccgggcctcctgcactctgcactgtagcatcctcagggccaagggcctcaagcccatggatttcaatggcctcgccgacccctacgtcaagctgcacttgctgcctggagcctgtaaggccaataagctaaaaacgaagactcagaggaacacactgaatcccgtgtggaatgaggacctgacttacagcgggatcacagatgacgacatcacgcacaaggtgctcaggatcgccgtctgtgatgaggacaagctgagtcacaatgagtttattggggagatccgcgtgcccctccgccgcctcaagccttcgcagaagaagcattttaacatctgcctcgagcgccaggtcccgctggcgtccccctcttccatgtcagcggcgctgaggggcatctcctgttatctgaaggagttggagcaggcggagcaggggcaggggctgctggaggagcgtggccgcatcctgctgagtctcagctacagctcgcggcgccggggactgctggtaggcatcttgcgctgcgcccatctggctgccatggacgtcaacggttactcggacccctacgtcaagacgtacctgaggcccgatgtggacaagaaatccaagcataagacgtgtgtgaagaagaagactctcaacccagaatttaacgaggagtttttctacgagatagagctctccactctggccaccaagaccctggaagtcaccgtctgggactatgacattggcaaatccaatgacttcattggtggcgtgtccctggggccaggtgcccgaggcgaggctcggaagcactggagtgactgcctgcagcagccggacgcagccctggagcgctggcacaccctgaccagtgagctgccccctgcggccggggctctgtcctcagcctgagtggacagcagtgtcccggcacaggcccatcgagccgggtccagtacccaaccttcgcacgagtgtgttgcacgtttacacagggtgggctgcccccaccctgcactacctatttttgtgagtctccgtgacccgggtctgtctgctcatgaggggctgcggagttctatattcacatatgcaaacctcctgcctgactcgctagtccctgcaaatatgcaaaccccccatcatctgcacacccgggcagtgctcagagcccggccccaggcccccgcgctcctcactcctgcctctccacgctgccccgtccctctcccccaacagggaggaggtcggattaggggaggttcagaggaggagaatgtctcaaaaaaaaaggacaaaaaacaaacccagagccactcctttaatacagaaacttcattgaaaaaacctagccctgtacagctgcccttttaaagaggtggccattgcagggtctctgcctccccagcaggtggcagatgctcccggccactcgtttaaataactgtcccctggagggggccggggtttgaaggcagggcccctgccaccctcctgggggacacccgtgcatgtttacgccttttctggttgtgtcagtggccggagcatggcagctgggcatcaataaacacctccgagg

SEQ ID NO: 127943 - DNA, 6048 bp, Homo sapiens
  Payload ID: 5051
  Gene Symbol: DOC2B
  Gene Name: double C2-like domains, beta
  ENST ID: ENST00000496357
  CDS Start-End: 158-1396
tccgcagcggagcgggcagcggccaagtcagggccgtccgggggcgcggccggcgatgcccgcagcccccgccgcgccccgccgggcctgctgagccgcccccgggccggggtcgcgccgggccgggccgcgcccggggcggggcggcgctgcctgcatgaccctccggcggcgcggggagaaggcgaccatcagcatccaggagcatatggccatcgacgtgtgccccggccccacccggcccatcaagcagatctccgactacttcccccgcttcccgcggggcctgcccccggacgccgggccccgagccgctgcacccccggacgcccccgcgcgcccggctgtggccggtgccggccgccgcagcccctccgacggcgcccgcgaggacgacgaggatgtggaccagctcttcggagcctacggctccagcccgggccccagcccgggtcccagccccgcgcggccgccagccaagccgccggaggacgagccggacgccgacggctacgagtcggacgactgcactgccctgggcacgctggacttcagcctgctgtatgaccaggagaacaacgccctccactgcaccatcaccaaggccaagggcctgaagccaatggaccacaatgggctggcagacccctacgtcaagctgcacctgctgccaggagccagtaaggcaaataagctcagaacaaaaactctccgtaacactctgaaccccacatggaacgagaccctcacttactacgggatcacagatgaagacatgatccgcaagaccctgcggatctctgtgtgtgacgaggacaaattccggcacaatgagttcatcggggagacacgtgtgcccctgaagaagctgaaacccaaccacaccaagaccttcagcatctgcctggagaagcagctgccggtggacaagactgaagacaagtccctggaggagcggggccgcatcctcatctccctcaagtacagctcacagaagcaaggcctgctggtaggcatcgtgcggtgcgcccacctggccgccatggacgccaacggctactcggacccctacgtgaaaacatacctgaggccagatgtggacaagaaatccaaacataagacagcggtgaagaaaaaaaccctgaacccggagtttaatgaggagttctgttacgagatcaagcatggggacctggccaagaagtccctggaggtcaccgtttgggattacgacattggaaaatccaacgatttcattggtggtgtggttctgggcatccacgccaagggggagcgcctgaagcactggtttgactgcctgaagaacaaggacaagcgcatcgagcgctggcacacgctcaccagcgagctcccaggggctgtgctcagcgactgacgcccacccgccactgctacccctgccgccacctgcgcccagcacggccggccccgggcttccccagcagccaccaaggcctgtggcccccacactgggggagatccagaacccctgcttggacacagagccactgcagtccccgctcggaggatgtggagggctcagccactctgggacggggagggcaaggagctggggtggggggctctcagctctctggggcccaagaggccggtggtggaaagagacctcagcacctgcccaggggaaggggacacgcccatctgggagcaaagacccttctagaggccagccccggctgagaggacaggagtgtgggggcgccttggcggacagtgggaacagaggagggaggtggtgagcagacagacaggtggaggatgggaccttgaagactggctgctccagcccaagaaagcctaactgcatccctcatctccttcgctgctggacagatggaagaagcgggcctgccggccgaaagtctgccagagttcccggaggctcctgatgatgggtaaattggcacatgcttcactcaatgattccacaagccctgggggtgaatgagacacagggcctgccctcagggagttcccatctagtcaggaagctgggaacaaaccattccaactggggtgagaaataccaagaccagcttggccagtctgcaagtaccgtgggctctgctgactctgccgggaggtcagggacggcttcctggaggaggcggtgcttccgtaaggccttggagggtgagtgagggcttctaaaagcagtccaggcagtgggagtggtctaaaacgcctggagagagaaagccaatggggccggggtgctgtggacccagggtctcctctccaggggagggtttgttaggaaggtgtgaggctcgaggcaggaggtgggggacgtgatggaaacaccatggagaaactggtgtaggctcaagttcagacctcagacccaagtctcccactctgatctctttctactcctgagggacctcaaggacggagcccgcccctcctccttcctggcataagcatcaggtcagctgcagtggagaaaagggtcccttgtgcttgggaaaaaaagcaagcattcctacacgtcctgactctgccctttcccctcccctccactccatggctcacactgggggcctccgggtgcttgctcgtggcatcttggtcccactaccgccacagatgtcccttttgggagtaatcagtggccgtccagggccttgtctctggggaggcctgtggggccagctccaccctccaggagctgagcaagaatcaccctggctggtgggcctgtctgctcccctgagtgagactccccaggaggcttgagagtatctgaatcttggggcccatgcctgaagcccacaaactttctctgcctaccaagggcccctcaggaacgctgggtgaacaaatgcagagccaaggagttgcacagccagagtcccagtgtgctcagcccatcagtgtgtgatggaaacaggcccagagaggtcaggtgacctgcccagggccttccaggccccacacagctggaaccaggatccacagcccccagcccagagtgctggacaccacgcttcaggggaattggcgtgctgagctcacaccagagaggtcctgctagctgccagcctggggctcccccgcctgctgcccaccccttcaacaccgatagagggactcacaggcacgacggtgggaccttccactgcagacacaaagcacaccaccacctgaggtccagggttatgatttgaatcctaccaagtgcccatcaggcctttcccaggttgcggggaaaacaggaccccagcccccacacagtccctggccacctgctgctcctggagacttgtctccctgcctttaggaagggtttttgtgtgaaggtttttgcatgcactggtctgaacgcatgttcacagccctgcaaggtgggtttgattctcatccccatcttgcaggtgaaacaggttcccagagtctgagtagtttgccaaggccacacagccaggaaggggtgaaccaggactcaaacccaggtcctctgactgccgctttctctctctgggggtcggtacccccagtcccttccctcttggtctgtcggagactcagcagagacaccaggtgaaggctcagtaagctcaggtgcatgatggagacctggggtcttgtcactgtcctgccacctcatccgctggctttgaaaccatccgtgctacttcaggcttccccagaggtgtctaacctggccccaaaactcagccaccccaccctagcctctgggggctgaggcaagggctcctcttttctccacacagaatgggcaccctctgggggcctaaggtaagaggtggtctatttctaaaaggcctggtgtctagttaagctctgggtatcttcttagctttgcttttttgggggtctcattcagagaggagatttgacagcctctctgaagacacagaagtgaatggcaaagcgagaagaggctgtaccccccacctaccatgacttccttattaggcacatggggaatgtgaggcccagtgggtgaaaggggcctgaaggggcacagctgggacaagaacccagaactccagccccccagtccagggccctctactgcccaggctgtgcaaatggggctgggaccgaaagatggggacagtcaggctgggaggcgggcttactggccagccagcccaggggcagcacaggcactcgggcaggaactccccaggaagtttggatccttccttccctaggatctcagcacccttttagatcccgtgcagattgtctttctgttaaagcgttttgaggcacgatggctcacgcctgtaattgcagcactttgggaggccgaggctggcggatcacctgaggtcaggagttcgaaacccgcctggccaacagggcgaaaccccatctctactaaaaatacaaaaattagccgggtgtggtggcgcacgcctgtagtcccagctactcagggaggctgaggcacgagaatcgcttgaacccgggaggtgaaggctgcagtgagccaagatcgcggcactgcactccagcctgggcgacagagcaagactccgtctcagaaaaaaaacaaacaaacaacgctttgagaagctgcagaagcggctctgcctttgaccccgaatgggcatctttactcgggtccatcatccccacaaagacaggaaatctgatgccaaaaaaaaaaagtcattccaggtgtcagtaaccaggcgctgcctccagcgccgccccgcccgccgccccgcccgccgccccgcccgccgcctgcgccaatccccgacgggcccgtcttccagccccgaagcggtcacctcctgacctctagtggcgagcgcggggaactgcgccccggcccgtccgcccgccgagcccgggccgtgcatgccgagcccgttgttccttcgcaaaccgagtgaacctcccgatgcatggactctggctgtcgtcgacgcagactctcgtgcactgcttaaccccgttttgctgccatgtgacggctgcagacactgtcctcaaactgcagtcccacagacaagttttgtattttggtctgacctacccgaaggtgtcctttttaagtcttatttgttaatatttataatgacatataatccaaagtaaatggaaacgtcatattgcgatctcattgccttggcgagactctcaccttttaatagatttgaaggggtgggggcggtggctcacgcctgtaagtcctagcacttttggaggtcgaggtgggagaattgcttgaggcctggagttcgagaccagcctggtcaacatggagaaaccacgcctctacacacacagagacacacacaatgacaattagcctagcgtggtggcacacacctgtagccccagcttttcaggaggctgaggtaggaggaggaggatcgcttgagcctggaaagtggggattgcagtgagccgagatcacgccaccgcactccagcctgggcaacagagggagaccttgtcaaaaaaaaaaaaaaaagatttggaagggtaggaggggagggtggaaagacggaggaaaaggcaactgaaacctactccggatatagtcttgttactcttcaccagggacccatttgaggtaggccctcaagttacagatggggaaactaaggcccagagaggttaaaatacttttacagaatcacacggctggtcgatggcagaagcaggattcaaactgaggcagcccaagacattttgcaccaggacctgtcgaccatgctgttgtccactcatccaacaaacagccgtggagtattgactaacgccagcccgtctgaggctccaagagtcttacgttttggaaggtaatttaagacatgtactgcttaggtttggagggaaaaaaataaaccttcctaaccacagattagtgtattaggactagtagcaatccccacactttatattttcattccaccttgttagaaaatgttgatcaattgttgaatacagtttattgtacatcattctttaggtcagaaatttctcgagataaaagcctttgctttctaacatcga

SEQ ID NO: 127944 - DNA, 6048 bp, Homo sapiens
  Payload ID: 5051
  Gene Symbol: DOC2B
  Gene Name: double C2-like domains, beta
  ENST ID: ENST00000613549
  CDS Start-End: 158-1396
tccgcagcggagcgggcagcggccaagtcagggccgtccgggggcgcggccggcgatgcccgcagcccccgccgcgccccgccgggcctgctgagccgcccccgggccggggtcgcgccgggccgggccgcgcccggggcggggcggcgctgcctgcatgaccctccggcggcgcggggagaaggcgaccatcagcatccaggagcatatggccatcgacgtgtgccccggccccatccgtcccatcaagcagatctccgactacttcccccgcttcccgcggggcctgcccccggacgccgggccccgagccgctgcacccccggacgcccccgcgcgcccggctgtggccggtgccggccgccgcagcccctccgacggcgcccgcgaggacgacgaggatgtggaccagctcttcggagcctacggctccagcccgggccccagcccgggtcccagccccgcgcggccgccagccaagccgccggaggacgagccggacgccgacggctacgagtcggacgactgcactgccctgggcacgctggacttcagcctgctgtatgaccaggagaacaacgccctccactgcaccatcaccaaggccaagggcctgaagccaatggaccacaatgggctggcagacccctacgtcaagctgcacctgctgccaggagccagtaaggcaaataagctcagaacaaaaactctccgtaacactctgaaccccacatggaacgagaccctcacttactacgggatcacagatgaagacatgatccgcaagaccctgcggatctctgtgtgtgacgaggacaaattccggcacaatgagttcatcggggagacacgtgtgcccctgaagaagctgaaacccaaccacaccaagaccttcagcatctgcctggagaagcagctgccggtggacaagactgaagacaagtccctggaggagcggggccgcatcctcatctccctcaagtacagctcacagaagcaaggcctgctggtaggcatcgtgcggtgcgcccacctggccgccatggacgccaacggctactcggacccctacgtgaaaacatacctgaggccagatgtggacaagaaatccaaacataagacagcggtgaagaaaaaaaccctgaacccggagtttaatgaggagttctgttacgagatcaagcatggggacctggccaagaagtccctggaggtcaccgtttgggattacgacattggaaaatccaacgatttcattggtggtgtggttctgggcatccacgccaagggggagcgcctgaagcactggtttgactgcctgaagaacaaggacaagcgcatcgagcgctggcacacgctcaccagcgagctcccaggggctgtgctcagcgactgacgcccacccgccactgctacccctgccgccacctgcgcccagcacggccggccccgggcttccccagcagccaccaaggcctgtggcccccacactgggggagatccagaacccctgcttggacacagagccactgcagtccccgctcggaggatgtggagggctcagccactctgggacggggagggcaaggagctggggtggggggctctcagctctctggggcccaagaggccggtggtggaaagagacctcagcacctgcccaggggaaggggacacgcccatctgggagcaaagacccttctagaggccagccccggctgagaggacaggagtgtgggggcgccttggcggacagtgggaacagaggagggaggtggtgagcagacagacaggtggaggatgggaccttgaagactggctgctccagcccaagaaagcctaactgcatccctcatctccttcgctgctggacagatggaagaagcgggcctgccggccgaaagtctgccagagttcccggaggctcctgatgatgggtaaattggcacatgcttcactcaatgattccacaagccctgggggtgaatgagacacagggcctgccctcagggagttcccatctagtcaggaagctgggaacaaaccattccaactggggtgagaaataccaagaccagcttggccagtctgcaagtaccgtgggctctgctgactctgccgggaggtcagggacggcttcctggaggaggcggtgcttccgtaaggccttggagggtgagtgagggcttctaaaagcagtccaggcagtgggagtggtctaaaacgcctggagagagaaagccaatggggccggggtgctgtggacccagggtctcctctccaggggagggtttgttaggaaggtgtgaggctcgaggcaggaggtgggggacgtgatggaaacaccatggagaaactggtgtaggctcaagttcagacctcagacccaagtctcccactctgatctctttctactcctgagggacctcaaggacggagcccgcccctcctccttcctggcataagcatcaggtcagctgcagtggagaaaagggtcccttgtgcttgggaaaaaaagcaagcattcctacacgtcctgactctgccctttcccctcccctccactccatggctcacactgggggcctccgggtgcttgctcgtggcatcttggtcccactaccgccacagatgtcccttttgggagtaatcagtggccgtccagggccttgtctctggggaggcctgtggggccagctccaccctccaggagctgagcaagaatcaccctggctggtgggcctgtctgctcccctgagtgagactccccaggaggcttgagagtatctgaatcttggggcccatgcctgaagcccacaaactttctctgcctaccaagggcccctcaggaacgctgggtgaacaaatgcagagccaaggagttgcacagccagagtcccagtgtgctcagcccatcagtgtgtgatggaaacaggcccagagaggtcaggtgacctgcccagggccttccaggccccacacagctggaaccaggatccacagcccccagcccagagtgctggacaccacgcttcaggggaattggcgtgctgagctcacaccagagaggtcctgctagctgccagcctggggctcccccgcctgctgcccaccccttcaacaccgatagagggactcacaggcacgacggtgggaccttccactgcagacacaaagcacaccaccacctgaggtccagggttatgatttgaatcctaccaagtgcccatcaggcctttcccaggttgcggggaaaacaggaccccagcccccacacagtccctggccacctgctgctcctggagacttgtctccctgcctttaggaagggtttttgtgtgaaggtttttgcatgcactggtctgaacgcatgttcacagccctgcaaggtgggtttgattctcatccccatcttgcaggtgaaacaggttcccagagtctgagtagtttgccaaggccacacagccaggaaggggtgaaccaggactcaaacccaggtcctctgactgccgctttctctctctgggggtcggtacccccagtcccttccctcttggtctgtcggagactcagcagagacaccaggtgaaggctcagtaagctcaggtgcatgatggagacctggggtcttgtcactgtcctgccacctcatccgctggctttgaaaccatccgtgctacttcaggcttccccagaggtgtctaacctggccccaaaactcagccaccccaccctagcctctgggggctgaggcaagggctcctcttttctccacacagaatgggcaccctctgggggcctaaggtaagaggtggtctatttctaaaaggcctggtgtctagttaagctctgggtatcttcttagctttgcttttttgggggtctcattcagagaggagatttgacagcctctctgaagacacagaagtgaatggcaaagcgagaagaggctgtaccccccacctaccatgacttccttattaggcacatggggaatgtgaggcccagtgggtgaaaggggcctgaaggggcacagctgggacaagaacccagaactccagccccccagtccagggccctctactgcccaggctgtgcaaatggggctgggaccgaaagatggggacagtcaggctgggaggcgggcttactggccagccagcccaggggcagcacaggcactcgggcaggaactccccaggaagtttggatccttccttccctaggatctcagcacccttttagatcccgtgcagattgtctttctgttaaagcgttttgaggcacgatggctcacgcctgtaattgcagcactttgggaggccgaggctggcggatcacctgaggtcaggagttcgaaacccgcctggccaacagggcgaaaccccatctctactaaaaatacaaaaattagccgggtgtggtggcgcacgcctgtagtcccagctactcagggaggctgaggcacgagaatcgcttgaacccgggaggtgaaggctgcagtgagccaagatcgcggcactgcactccagcctgggcgacagagcaagactccgtctcagaaaaaaaacaaacaaacaacgctttgagaagctgcagaagcggctctgcctttgaccccgaatgggcatctttactcgggtccatcatccccacaaagacaggaaatctgatgccaaaaaaaaaaagtcattccaggtgtcagtaaccaggcgctgcctccagcgccgccccgcccgccgccccgcccgccgccccgcccgccgcctgcgccaatccccgacgggcccgtcttccagccccgaagcggtcacctcctgacctctagtggcgagcgcggggaactgcgccccggcccgtccgcccgccgagcccgggccgtgcatgccgagcccgttgttccttcgcaaaccgagtgaacctcccgatgcatggactctggctgtcgtcgacgcagactctcgtgcactgcttaaccccgttttgctgccatgtgacggctgcagacactgtcctcaaactgcagtcccacagacaagttttgtattttggtctgacctacccgaaggtgtcctttttaagtcttatttgttaatatttataatgacatataatccaaagtaaatggaaacgtcatattgcgatctcattgccttggcgagactctcaccttttaatagatttgaaggggtgggggcggtggctcacgcctgtaagtcctagcacttttggaggtcgaggtgggagaattgcttgaggcctggagttcgagaccagcctggtcaacatggagaaaccacgcctctacacacacagagacacacacaatgacaattagcctagcgtggtggcacacacctgtagccccagcttttcaggaggctgaggtaggaggaggaggatcgcttgagcctggaaagtggggattgcagtgagccgagatcacgccaccgcactccagcctgggcaacagagggagaccttgtcaaaaaaaaaaaaaaaagatttggaagggtaggaggggagggtggaaagacggaggaaaaggcaactgaaacctactccggatatagtcttgttactcttcaccagggacccatttgaggtaggccctcaagttacagatggggaaactaaggcccagagaggttaaaatacttttacagaatcacacggctggtcgatggcagaagcaggattcaaactgaggcagcccaagacattttgcaccaggacctgtcgaccatgctgttgtccactcatccaacaaacagccgtggagtattgactaacgccagcccgtctgaggctccaagagtcttacgttttggaaggtaatttaagacatgtactgcttaggtttggagggaaaaaaataaaccttcctaaccacagattagtgtattaggactagtagcaatccccacactttatattttcattccaccttgttagaaaatgttgatcaattgttgaatacagtttattgtacatcattctttaggtcagaaatttctcgagataaaagcctttgctttctaacatcga

SEQ ID NO: 127945 - DNA, 768 bp, Homo sapiens
  Payload ID: 5052
  Gene Symbol: DUX4
  Gene Name: double homeobox 4
  ENST ID: ENST00000570263
  CDS Start-End: 1-483
atggccctcccgacaccctcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggtctaggcccggtgagagactccactccgcggagaactgcctttctttcctgggcatcccggggatcccagagccggcccaggtaccagcagacctgcgcgcagtgcgcaccccggctgacgtgcaagggagctcgctggcctctctgtgcccttgttcttccgtgaaattctggctgaatgtctccccccaccttccgacgctgtctaggcaaacctggattagagttacatctcctggatgattagttcagagatatattaaaatgccccctccctgtggatcctatag

SEQ ID NO: 127946 - DNA, 1574 bp, Homo sapiens
  Payload ID: 5052
  Gene Symbol: DUX4
  Gene Name: double homeobox 4
  Uniprot ID: Q9UBX2
  ENST ID: ENST00000569241
  CDS Start-End: 1-1275
atggccctcccgacaccctcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagaggggatctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgccggggcggcgtgggaaccccaagccggggcagctccacctccccagcccgcgcccccggacgcctccgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggccgcctcgctggaagcacccctcagcgaggaagaataccgggctctgctggaggagctttaggacgcggggtctaggcccggtgagagactccactccgcggagaactgcctttctttcctgggcatcccggggatcccagagccggcccaggtaccagcagacctgcgcgcagtgcgcaccccggctgacgtgcaagggagctcgctggcctctctgtgcccttgttcttccgtgaaattctggctgaatgtctccccccaccttccgacgctgtctaggcaaacctggattagagttacatctcctggatgattagttcagagatatattaaaatgccccctccctgtggatcctatag

SEQ ID NO: 127947 - DNA, 1710 bp, Homo sapiens
  Payload ID: 5052
  Gene Symbol: DUX4
  Gene Name: double homeobox 4
  Uniprot ID: Q9UBX2
  ENST ID: ENST00000565211
  CDS Start-End: 1-1275
atggccctcccgacaccctcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagaggggatctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgccggggcggcgtgggaaccccaagccggggcagctccacctccccagcccgcgcccccggacgcctccgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggccgcctcgctggaagcacccctcagcgaggaagaataccgggctctgctggaggagctttaggacgcggggttgggacggggtcgggtggttcggggcagggcggtggcctctctttcgcggggaacacctggctggctacggaggggcgtgtctccgccccgccccctccaccgggctgaccggcctgggattcctgccttctaggtctaggcccggtgagagactccactccgcggagaactgcctttctttcctgggcatcccggggatcccagagccggcccaggtaccagcagacctgcgcgcagtgcgcaccccggctgacgtgcaagggagctcgctggcctctctgtgcccttgttcttccgtgaaattctggctgaatgtctccccccaccttccgacgctgtctaggcaaacctggattagagttacatctcctggatgattagttcagagatatattaaaatgccccctccctgtggatcctatag

SEQ ID NO: 127948 - DNA, 1275 bp, Homo sapiens
  Payload ID: 5052
  Gene Symbol: DUX4
  Gene Name: double homeobox 4
  Uniprot ID: Q9UBX2
  ENST ID: ENST00000616166
  CDS Start-End: 1-1275
atggccctcccgacaccctcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagaggggatctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgccggggcggcgtgggaaccccaagccggggcagctccacctccccagcccgcgcccccggacgcctccgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggccgcctcgctggaagcacccctcagcgaggaagaataccgggctctgctggaggagctttag

SEQ ID NO: 127949 - DNA, 1006 bp, Homo sapiens
  Payload ID: 5053
  Gene Symbol: DUXA
  Gene Name: double homeobox A
  Uniprot ID: A6NLW8
  ENST ID: ENST00000554048
  CDS Start-End: 1-615
atggccgaagacacctattcacacaagatggtaaaaacaaatcataggcgctgtcgcacaaaattcacagaagaacagttgaaaatcctcatcaataccttcaatcaaaagccttacccaggttatgctaccaaacaaaaacttgctttagaaatcaatacagaagagtccagaatccagatttggtttcagaatcgaagagctaggcacggattccagaaaagaccagaagctgagactttagaatcaagccagagccaggggcaagatcaacctggtgtggagtttcaaagtagagaagccagacggtgtcgtaccacctacagcgcctctcagttacacactctcatcaaggcatttatgaaaaacccatatcctgggattgattccagagaagaacttgctaaagaaatcggtgttccagagtcaagagtccaaatttggttccaaaatcgaagatctagattacttctccagagaaaaagggaacctgtggcgtccttagaacaagaagagcagggcaagattcctgagggactgcaaggtgcagaagatacacaaaatggcaccaacttcactagtgactctcatttctctggagccagaacgtggtgaacacagtcaaattcagtgtacttgataatatcaactggaccccaaatctgtctcacggtcttcctgggagtctatccttctgctgaaactgcaagctaagccttctgaagatggtaaaggacttggccagatgtggtgggtcacacttgtaatcccactactttgggaggccaaggcaggaagattgcttgagctcaggagtttgaaaccagcctggacaacatatagcaagactctgcctctattataaaaaaacaaaataaatgaaaaggactgtaggaggcagagacgggtacagggggtaccacactaccctgttgacacagcctagatccagagttcagaagaccttgagacaatgaaaataaacttggtaataatcttttttcaa

SEQ ID NO: 127950 - DNA, 3498 bp, Homo sapiens
  Payload ID: 5054
  Gene Symbol: DZANK1
  Gene Name: double zinc ribbon and ankyrin repeat domains 1
  Uniprot ID: Q9NVP4
  ENST ID: ENST00000262547
  CDS Start-End: 210-2468
agatgcctatgggaaagcactgggaaaggaactccaggcgggtaccaggctccctgcggagcggcaggggccggtctagttgctaagaagctgagtctccaccaatcatctgcccagcacccagtgggcggggcgcggctcgccgcgtctgtggtaacccgggcggcggcgaaggaggaggcaagaggcgagagagagagagagagaaaatgactgctggttcagtgtgtgtccctcagatcataccattacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcaggaattcaaaaatggatttgttggatcaaaactaaagaaaaaatataagaactctgaaaatcaacgcagctggaatgttaaccttagaaagtttccagagagtccattggaaatcccagcttatggtggaggatcaggttctagaccacccacccgccagtcccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgtgt

SEQ ID NO: 127951 - DNA, 1389 bp, Homo sapiens
  Payload ID: 5054
  Gene Symbol: DZANK1
  Gene Name: double zinc ribbon and ankyrin repeat domains 1
  ENST ID: ENST00000329494
  CDS Start-End: 1-1389
atgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttag

SEQ ID NO: 127952 - DNA, 3739 bp, Homo sapiens
  Payload ID: 5054
  Gene Symbol: DZANK1
  Gene Name: double zinc ribbon and ankyrin repeat domains 1
  ENST ID: ENST00000357236
  CDS Start-End: 1032-2711
aatctttattcccaaatatctgcaaagcctccccactgtgaagagtcaattagatccatctgagaaggatgtgtgacgcttcaggcactgggtgtgagcatcgataagaaagattcaaggagttaggccagaggatgggctagcctacagtaaggcggccaacccagaggtcttggtcacagggatgttgttgggattgacagaggaagtttataggggtttcacttaagcttgaccatgaacctgatgctagagaggaggttggtagatgcaggcatgggtgggactcaagtgtgatcaaggcaaggatctacactgggcaggggccgccttcgggggctaagccaacatatgtcagcaagtgcttaggcttgaatcaggtgtgagggaccaagtccatggagaaagtccagagagaagagtgtttaaggactgtgtgtgggcaggtggtgtgcagaagtctgattttggtctgactctaccctgcctttgccctctggacttggtggtccctctgttgttacccagactcccacagttgtaacatcctgcctgcatgtgctgctccctgcctcctgccttggccacttcacctggtgagggctacatccagatgtgctgccagctgagcagcccagtccagatacaaagctgcatgtttccagaataaagtgaaacaggggtcactttgtacaaatgaccataaactctttcaaataagaaatgcacaccatgacactttctctatcatgcagctttaattctcacatgggaataaccaagtgattgatatgcaatctcttcattcctaggaattcaaaaatggatttgttggatcaaaactaaagaaaaaatataagaactctgaaaatcaacgcagctggaatgttaaccttagaaagtttccagagagtccattggaaatcccagcttatggtggaggatcaggttctagaccacccacccgccagtcccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagccccgatgtgcctggcagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgt

SEQ ID NO: 127953 - DNA, 3310 bp, Homo sapiens
  Payload ID: 5054
  Gene Symbol: DZANK1
  Gene Name: double zinc ribbon and ankyrin repeat domains 1
  Uniprot ID: Q9NVP4
  ENST ID: ENST00000358866
  CDS Start-End: 24-2282
agagagagagagagagagagaaaatgactgctggttcagtgtgtgtccctcagatcataccattacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcaggaattcaaaaatggatttgttggatcaaaactaaagaaaaaatataagaactctgaaaatcaacgcagctggaatgttaaccttagaaagtttccagagagtccattggaaatcccagcttatggtggaggatcaggttctagaccacccacccgccagtcccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgt

SEQ ID NO: 127954 - DNA, 3295 bp, Homo sapiens
  Payload ID: 5054
  Gene Symbol: DZANK1
  Gene Name: double zinc ribbon and ankyrin repeat domains 1
  ENST ID: ENST00000377630
  CDS Start-End: 55-798
aacccgggcggcggcgaaggaggaggcaagaggcgagagagagagagagagaaaatgactgctggttcagtgtgtgtccctcagatcataccattacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcaggaattcaaaaatggatttgttggatcaaaactaaagaaaaaatataagaactctgaaaatcaacgcagctggaatgttaaccttagaaagtttccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagccccgatgtgcctggcagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgtgtaa

SEQ ID NO: 127955 - DNA, 3538 bp, Homo sapiens
  Payload ID: 5054
  Gene Symbol: DZANK1
  Gene Name: double zinc ribbon and ankyrin repeat domains 1
  ENST ID: ENST00000608192
  CDS Start-End: 152-721
gagaggctggcgactgggttgggcgcggcagagatgcattaggggtcccgatcccgggccccgcggttagaggaagaggagggcggctagaggaggggaagagcttcccttactccagccgaaaggatgcagagagagagagagagagaaaatgactgctggttcagtgtgtgtccctcagatcataccattacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcaggaattcaaaaatggatttgttggatcaaaactaaagaaaaaatataagaactctgaaaatcaacgcagctggaatgttaaccttagaaagtttccagagagtccattggaaatcccagcttatggtggaggatcaggttctagaccacccacccgccagtcccaggcaagacacagtcccatttacatttaaaagttttctgtttggccacagtatggagattagaccatggaagaggaaagggagaacattatttaggaggcttttgttccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccactta

SEQ ID NO: 127956 - DNA, 3145 bp, Homo sapiens
  Payload ID: 5054
  Gene Symbol: DZANK1
  Gene Name: double zinc ribbon and ankyrin repeat domains 1
  Uniprot ID: Q9NVP4
  ENST ID: ENST00000609267
  CDS Start-End: 381-2105
aatgtcaatgcccatcggacgcacaagcctggttccttcattctgagttgggaaaccaacttttagcacttggcaactctgtgaaggaatattcttagatgcctatgggaaagcactgggaaaggaactccaggcgggtaccaggctccctgcggagcggcaggggccggtctagttgctaagaagctgagtctccaccaatcatctgcccagcacccagtgggcggggcgcggctcgccgcgtctgtggtaacccgggcggcggcgaaggaggaggcaagaggcgttttgctgcatttaaattaagtgctgctcttcagcttttgtgtacattggaatttatatgtatatatatatagagagagagagagagagagaaaatgactgctggttcagtgtgtgtccctcagatcataccattacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcaggaattcaaaaatggatttgttggatcaaaactaaagaaaaaatataagaactctgaaaatcaacgcagctggaatgttaaccttagaaagtttccagagagtccattggaaatcccagcttatggtggaggatcaggttctagaccacccacccgccagtcccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaaggtgaggaaactgaggctcagagaagttaagcaacctgcttcttccaagggcactaagttagtaagtggcagacccaggattcacacttggcagcctgagaccttcccatcatgacaccctaattccaagacattgaaggactttaagcagagaaatgacacaatcacttataaaggatctaaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctc

SEQ ID NO: 127957 - DNA, 3156 bp, Homo sapiens
  Payload ID: 5054
  Gene Symbol: DZANK1
  Gene Name: double zinc ribbon and ankyrin repeat domains 1
  ENST ID: ENST00000460891
  CDS Start-End: 235-978
gaggcggtgagaggctggcgactgggttgggcgcggcagagatgcattaggggtcccgatcccgggccccgcggttagaggaagaggagggcggctagaggaggggaagagcttcccttactccagccgaaaggatgcagttttgctgcatttaaattaagtgctgctcttcagcttttgtgtacattggaatttatatgtatatatatatagagagagagagagagagagaaaatgactgctggttcagtgtgtgtccctcagatcataccattacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcaggaattcaaaaatggatttgttggatcaaaactaaagaaaaaatataagaactctgaaaatcaacgcagctggaatgttaaccttagaaagtttccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggtaatgaaatgtgattctgtaaaaacatgaatgaaatacatagtaatgtttgaacaggtatatgtcctttttcagctagtgggatggggtaacaatttttttttttttttgagacagaatcttgttctgtcacacaggctggagtgcagtagcgcaatctcagctcactgcaacctccgcctcctcagttcaagtgattctcctgcctcagcctcctgagtagctggaactacaggcgtgcaccaccacgcatggctaatttttatatttttagtagacatggggtttcatcatcttggccaggctggtctcaaactcctgacctcaggtgatgcgcccacctcagcctcccaaagtgctggattacaggcataagccaccatgcccgccaggatggggtaacaattgataagctaatatacatgaacaaaatccattctatttttagtaaggtatgctgtccaagagtttaatttgccaataggatctataatattaagagagatatgtaggattgtattccctgaacatggatttggagggcaaattgcactacagctaacaaagacaattttttacttcatatatttaaactccaacattgcagttagtgttgatttataattttgtccttaaagtggctcatacttttgtttgccttatttgattataggttcttgttatggagaaaaagaatgactagaactagtcacatggaagaaaaagttatgtatcatcacttacatccaaaaaactttgctcaaaaaatgatatcatactgtgaacatttttttgatagaatctttaaacatacaactaaatattttctccattcttcaatttacagtcccatttacttcctctttaatcccaagtaaaggtcactagaggataaaatagatttaatagagggaatttgggggattaaaaaactaagaatttttagcaataagggaaatgcatggcattatgtacaggccataacactcctaaaatggccttgtgggttgtatatgggcaaaatgtattcagagaaaagataaatccactttttctttcaccttcaagctccctttagcatgaagagttcacaagtgtacaaggctgtgtgagccttcagaaatgagattttgaataactggccaggccaaagtcagtttcaggacatctagggaccgcagtgctggactagaaaggaacacttgagcaccactggtcattatcaatggaaaaagattgtatcctgagagaatagtggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagccccgatgtgcctggcagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaaggtgggtgagatgaaatttccactccacaagtgtccacgggatcaggctgaaggaaccctccatggactttgcctgaaactgcatcttgcctggctcctttccctttcctgctctgctttctacactttcttactcttctgccttgtgagctctgctctaataaatcacttgcacatgaa

SEQ ID NO: 127958 - DNA, 1709 bp, Homo sapiens
  Payload ID: 5054
  Gene Symbol: DZANK1
  Gene Name: double zinc ribbon and ankyrin repeat domains 1
  ENST ID: ENST00000476058
  CDS Start-End: 1-677
tgacacaatcacttataaaggatctaaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgtgtaa

SEQ ID NO: 127959 - DNA, 837 bp, Homo sapiens
  Payload ID: 5054
  Gene Symbol: DZANK1
  Gene Name: double zinc ribbon and ankyrin repeat domains 1
  ENST ID: ENST00000480488
  CDS Start-End: 418-837
agatgcaggaaagtatgttagagaaaatgttggtgaccagtggctgagtgtggattagtagtgaagtctatgctctattggattacagagctgaaaaggatagatatcttccaggcatcaagcaggccggcaaacaccccttgatttgctgacttttagataataaatggctaatcctggatcaggctggaagttgctgagaaagacaggagcaaggaagatgaggcaaaggctggaaaaccctattagttccaaccccgatgtgcctggcagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagctt

SEQ ID NO: 127960 - DNA, 9405 bp, Homo sapiens
  Payload ID: 5055
  Gene Symbol: DCX
  Gene Name: doublecortin
  Uniprot ID: O43602
  ENST ID: ENST00000338081
  CDS Start-End: 173-1498
cttatttcttatgaatgtcggatagctgcaccagcttggtggggaaagggtttgatgaatagcacaaagacactggctgttccctggaggctgtccctttaaaggagaatcttagtttattctggggggaggggatgcacacattagagtaggaaagagggcttggaataaaatgaaaacactcccccttcatagtcattgtactgaaatgcaaagactgcttcctaagctggagatgctaaccttgggtagctccttctgttctcttcaaggggaattttgtcaggctatggattcatttacaactgttagtcatgtgggcatgtgtgaggaaacagatgccagttttaatgtatttagcccgaagttccaatttgataggagccactgtcagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgcactgtgtaggggggaacccagtggtggtggggtagctcagatgcccctagacaagcttcagatgtctgtagctaccagaaacattttcggttcaggaaaagtgagatgatggtagtactggtttctggtgaaattgaagaaccccaaatgatgaggatctctttttgccccctctcctttttttgtagacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaacttcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattggcccactttcaaggcaattttttttgtgtgtctgtaactgagctcctccacccctgtcattcacttccaattttacccaatccaattttagcactcaagttccattgtgttaatttctgcacggtcaacaaacatcaagtcagcaagcatttgccaccactccctatacttctccctccttcttacacacacacacacacacacacacacaatccatctcttgcttgttcctacctcctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaagaaagagtggaacaatagctttgttcatcctaactttctgagatggcttttcaacattttaaaaaaactagtgtggctaccattcactggcaatgatttcttttagaatatgggagtaagatgagctagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctctagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaacgtctgtgccaagagacttccccagatagaaacactgggacagtggtttgaacgacttcttttatggttgtccagtttgctatggaaataaaaggcattgattttttaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccagaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaacttttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagccaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagacttgaaggcattagcgtttctcattactaggtcaataacctgagggaatcaatggctttttgccgctctacctcttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttcaat

SEQ ID NO: 127961 - DNA, 2981 bp, Homo sapiens
  Payload ID: 5055
  Gene Symbol: DCX
  Gene Name: doublecortin
  Uniprot ID: O43602
  ENST ID: ENST00000356220
  CDS Start-End: 101-1198
gagattggttttctttctctcagcatctccacccaaccagcagaaaaccgcttctacctgggattttcctttggaaaagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcaggtaacgaccaagacgcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgca

SEQ ID NO: 127962 - DNA, 9223 bp, Homo sapiens
  Payload ID: 5055
  Gene Symbol: DCX
  Gene Name: doublecortin
  ENST ID: ENST00000358070
  CDS Start-End: 1-1316
attgtactgaaatgcaaagactgcttcctaagctggagatgctaaccttgggtagctccttctgttctcttcaaggggaattttgtcaggctatggattcatttacaactgttagtcatgtgggcatgtgtgaggaaacagatgccagttttaatgtatttagcccgaagttccaatttgataggagccactgtcagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcaggtaacgaccaagacgcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgcactgtgtaggggggaacccagtggtggtggggtagctcagatgcccctagacaagcttcagatgtctgtagctaccagaaacattttcggttcaggaaaagtgagatgatggtagtactggtttctggtgaaattgaagaaccccaaatgatgaggatctctttttgccccctctcctttttttgtagacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaacttcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattggcccactttcaaggcaattttttttgtgtgtctgtaactgagctcctccacccctgtcattcacttccaattttacccaatccaattttagcactcaagttccattgtgttaatttctgcacggtcaacaaacatcaagtcagcaagcatttgccaccactccctatacttctccctccttcttacacacacacacacacacacacacacaatccatctcttgcttgttcctacctcctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaagaaagagtggaacaatagctttgttcatcctaactttctgagatggcttttcaacattttaaaaaaactagtgtggctaccattcactggcaatgatttcttttagaatatgggagtaagatgagctagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctctagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaacgtctgtgccaagagacttccccagatagaaacactgggacagtggtttgaacgacttcttttatggttgtccagtttgctatggaaataaaaggcattgattttttaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccagaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaacttttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagccaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagacttgaaggcattagcgtttctcattactaggtcaataacctgagggaatcaatggctttttgccgctctacctcttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttcaat

SEQ ID NO: 127963 - DNA, 9231 bp, Homo sapiens
  Payload ID: 5055
  Gene Symbol: DCX
  Gene Name: doublecortin
  Uniprot ID: O43602
  ENST ID: ENST00000371993
  CDS Start-End: 245-1327
tagagagattggttttctttctctcagcatctccacccaaccagcagaaaaccggtgagtggggcttttaagtgattttcaagaagaatgtaacagatgtcaaacgggaaaagcacaaggcaaagcctgctctctctgtctctctgtctcctcttctccttttttgccttattctatccgattttttccctaagcttctacctgggattttcctttggaaaagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgcactgtgtaggggggaacccagtggtggtggggtagctcagatgcccctagacaagcttcagatgtctgtagctaccagaaacattttcggttcaggaaaagtgagatgatggtagtactggtttctggtgaaattgaagaaccccaaatgatgaggatctctttttgccccctctcctttttttgtagacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaacttcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattggcccactttcaaggcaattttttttgtgtgtctgtaactgagctcctccacccctgtcattcacttccaattttacccaatccaattttagcactcaagttccattgtgttaatttctgcacggtcaacaaacatcaagtcagcaagcatttgccaccactccctatacttctccctccttcttacacacacacacacacacacacacacaatccatctcttgcttgttcctacctcctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaagaaagagtggaacaatagctttgttcatcctaactttctgagatggcttttcaacattttaaaaaaactagtgtggctaccattcactggcaatgatttcttttagaatatgggagtaagatgagctagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctctagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaacgtctgtgccaagagacttccccagatagaaacactgggacagtggtttgaacgacttcttttatggttgtccagtttgctatggaaataaaaggcattgattttttaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccagaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaacttttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagccaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagacttgaaggcattagcgtttctcattactaggtcaataacctgagggaatcaatggctttttgccgctctacctcttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttc

SEQ ID NO: 127964 - DNA, 518 bp, Homo sapiens
  Payload ID: 5055
  Gene Symbol: DCX
  Gene Name: doublecortin
  ENST ID: ENST00000468911
  CDS Start-End: 180-518
aatgctgagctcagcataggtcatggtgacattggaaaaaaggcggaattgagcctggcagacccattaggcaccagtctttcttatctcctgtcctcctggtcccttgcaaatatattgatgtggcagtgtgtagcagctgagccctgcttgctttgtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatc

SEQ ID NO: 127965 - DNA, 2422 bp, Homo sapiens
  Payload ID: 5055
  Gene Symbol: DCX
  Gene Name: doublecortin
  Uniprot ID: O43602
  ENST ID: ENST00000488120
  CDS Start-End: 261-1343
gaaacctttctagctgttaatgcagcctgtgaatttttttaaaagcatgtaattaatcataggaggttggggggattcactaagcctgagttacatgggagaagctggacaaggcactaggacctagaaggcatctatccaccctggcaggaatttcttgcttggagctcagacaacaaaggcatagagagattggttttctttctctcagcatctccacccaaccagcagaaaaccggtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaa

SEQ ID NO: 127966 - DNA, 4669 bp, Homo sapiens
  Payload ID: 5056
  Gene Symbol: DCDC1
  Gene Name: doublecortin domain containing 1
  ENST ID: ENST00000303697
  CDS Start-End: 1-1222
tgatggaaagagaaaaactatgctctgcttggcttgtggacaatccatgagaacagagaaaggactgaaacaattgcttccaggggttccattcctctgtatttcaggcaccaagactcagaagcccttcttacaagggcccttcaaggtcatcagtgtggctgaggttgatttgtcgtgtgacaaggctgaaaaaactctaagttactaccaagcacgtctattgtctttacggatgaagacctgcacgcaagctgcatctcacagtggcatggcagccacacaccagaaggcagtgaaaataattgcatacaaaaatggggatgggtatcgtaatgggaagttaattgtggctggaacattccccatgcttcttacagaatgcacggaacaacttgggcttgccagagcagcctccaaagtatataccaaagatggaaccccaatctttaccttgcgtgatttggttttatgggctctagatgaatcctttctccagagagactctgagaaacaaaagcaagatgcagctcctgttggaaaagaacagataattgttgaaagtatggaagaaaatccaagaatgaaagtgaaaaacagattatttgcaaaatctgtgacatccgatagtttggatggtatagacaagtctttgcttaccctcatcctcagaaatcctattgccatctgggtgtcttgtggtgaaccatttctacctccaaatgctttgcagaaagcagaaaaattagagaaacagaactggctaaaaaaggacagaattttggctgatctagataccatgagacacaaaatgagacagttaaaagggcggcgagtagcggcatgtcagccagccaccatggttcctaccaagagccctgtgcagcccgtggtggttgaaggaggctggaccgaacagactcaacaggaaattaaactcatggaacttataagacatacagaggcacacctttctgaaatccaagaaatggaatccaaaataaattttccaattgcaaccaaacgtatagcagtcaagccgagcaacctgtataagcagcccaacacaaaacgagtgtggatttatctaaatggaggcagacctgaagatggcacttatgcctggggcaaaactatttcagaggtcagcttactttatctgaagacatggatctttatttggagcaggaaagttttcttctattttttgataactgcttaaggttaatgtattctagattcctctccagtaacaccaataatgtataggtttaatatctgatgtcttgacattataaatgtttgacttttctctctcatacactttgtctcttttcctttttctgtatcctgtgagatcttctccacctagtctgccctaataatgatttgaatttctgtaatattgagtcttttttctttcttaccttctctcctcttgtcattcagctctctcttcatcctcacttgaaaccctatttcttctctcactagcagctatacaactttggttattatatttaacctctttgttctccatttttctcatcaacaaaaggtggatactaattatttccacagaacaaaattagattgttcttgagaacttttagaaaaatacccagtccctagaaatgtgtcaatatgttttaatcagtattactgttatcagcagcctcagcatctctcctgtatctgagcaatactcctttcctttaagctgtggttgtctcgtttctgtgtgtatctgtgagtatatttacacacagaagtcatattttttgaatttaggggtaacacaacacagatacttttgaaaatgtactcctgctgtaaatctttttcaaaatcttcaccttgagtacaatgtaccctttttttatgttgtagaatattttcattagctttacattgttgctattgttgatttttctatttatatttccttgtacaaggagagatcttttgataacagacagaataggttagttctctttggtgaccctagacatctacttgggagctgtcagaatcctccctcaatggtaggttgaaggattggtttgtatgcagagtatttaatcaaattgcttctgactggatggtatttggcaggagtagggctgcatttaaccaacatggcacatgtatacatatgtaacaaacctgcacattgtgcacatgtaccctagaacttaaagtatgataaaaaaatatataaaaatagataacattaaaaaaagactactctcctgttggtcctctctgactatcctattctatagaggggaatatatttttggataatttgaattattattaaattcaatccactcatcccttactcaaaatactgggtgaaaagctgcgctttttgaactgcatcgccccatcactcttcttgtcttggctcatattcctgatgcatttgccagatgcaaggtgtcatcacatgcccagccctgacccctgccattctgccttgttgtgagttgtagcatctaaacagatctataaacagaagtattgatggtgatttggagggctgatgtggacttggcacctgcattttgggggaacaggcttttggccctctaataggtgaaagccatacaggcagctgctgcaagactgctcctctcgtctcaaaatgacccacccagctagagcactgtacacccccagtggagagccaattcagtcctgggacgacatagagcgagatatggtcatctgtgtgtctatgggacatggtttcaaaaccccaaaagagttaaaacaactgatggagatcagagcaaattatgccagaatccgaaggcagcagggccctcaagccacagacattgtggtgtcaccatccacgaagctgctgtctctggcacatctccacaattaactcctatcagaaccatcggattttctgctgtatttttctggaaagaaaactttctttacccacttataaacagaagactgtgacaagaaggccaattatttccatcgctgaagactctaaatttggcaaatcttctaaataacaatcctgcatagtttattaaaaaaaattagtcgtaaaatttatccttcaaaaatctgcattttaaataaaccctgacagtgatttctcaagactgtaaagatattagtctgagaatgcaactctaacagactgctctgggcatcttttctctttgccttggccaggcctctcagaattgagtgagcgtgtgactccatttgcacagtgggacagatgagtacaactgaaataaaaagtggaggcctctgcaaaaaataaaaaataaaaaataaatttatccttcaaaataactcagttttttcaatgggcctattttgaagaatgaacattgaaaaatgagacaatatatccataaattcatagtatgacataccataatcgagagcattgttagccatagacattttgtatgccagtgaaatctgtatacattctctaaatttttccagtttatcgtgtggcttattggaaaaaaaaaagcatatacactgactgcatgttttgtctccccaactaaatgataagtgcctagagggcaggaacacccttggttttatttacttgggacagagctctacccacaagggctcactgataaaactcatcagtcccaccccacagcaacatgatggggacatgaggttcagttcttctactcttggcctgagccgcaaaccaaaattacaacagtacaatgggaatagaggatctgctttatagaatttcctttcagtcagctgctcagaaactacaatcctcagagtgaaattaaatggagttatactgggatagtcctctctgcttttcagaggaaagaaacacttctcgaaattgtgcaaatgaaagaaatgtcatggtataaactagacatcttatatccttaaaatatatctttgatgattatacatattggtttcaaatcccaagtttgaagaaacatccaaaagttatgtgaaattacttatagatgaattgacaacatttgagacttcgacaggcaatcatgaagcagttctcaagttgatttggtttatatagctctttaagaatcttttggaaagccataatctcacaaaatacagatatgcaattttttttttttgagatggagtctcactctgttgcccagtctggagttcagtggcgcgatctcagctcactacaagctccccttcccaggttcaagcaattctcctgtctcagcctcctgagtagctgggactacaggcgcctgccaccacacccagctaacttttgtatttttagtagagatggggtttcaccttgttggtcaagctggtctcaaactcctgacctcaggtgatccactcgcctctgcctcccaaagtgctgggattacaggcgtaagccaccacacccagcccaaaaaatgtttgtgcacagaactgtggatgtttgtcacagaactttccaaataaagaagttctgataaaagagaagatatttctcatttccataatctttaaggtgtgggggatacgtaatctggacttctcaaatggatgatttctaaatacgcgtcagatgaagtgattctaactttctctgtagtaatatcttattttgttttattcaaaaacaataaaccatgtagatttattagca

SEQ ID NO: 127967 - DNA, 3980 bp, Homo sapiens
  Payload ID: 5056
  Gene Symbol: DCDC1
  Gene Name: doublecortin domain containing 1
  Uniprot ID: P59894
  ENST ID: ENST00000342355
  CDS Start-End: 239-1051
gtttctggccgagctgatgtggccgtggcacagctcagaagcgacgctccgcccaccccgacgcggtctctatggtaaccggtcaccgcttctatggagtggcgtttactaccaattgcaaataagaaaattccagattccattccaagatggccaaataggaacagctccagcctgcagctcccagcgtgattaatgtagaagatgggtgatttctgcatttccaactaagctgaaaatggcaaaaacaggagcagaagatcacagagaagcactatctcagtcttccttatccctcttgactgaagcaatggaagtattacagcaaagtagccctgaaggcactttggatgggaatactgtaaacccaatttacaaatatattttgaatgatttaccaagagagtttatgtcatcccaggcaaaagcagttattaaaactactgatgattatttgcagtctcagtttggccccaacagactcgtgcattcagcagcagtatcagaagggtcaggacttcaagattgctccacacatcaaacagcatcagatcacagccatgatgaaatatcagacctagatagctacaaatcaaacagtaaaaacaattcttgttctatatcagcatccaagagaaacagacctgtcagtgctccagtgggtcaactgagggttgcagagttctcttctttaaaatttcagtcagcccggaattggcagaaattgtctcaaagacacaaacttcaaccaagagtgattaaagtaacagcttacaaaaatggatctagaacagtctttgccagagttactgtaccaaccatcaccttgctgctggaggagtgcacagaaaagctgaatctgaacatggccgcaagacgagtgttcttggcagacggcaaggaagccctcgaacctgaagatataccccatgaagccgatgtttatgtttcaacgggagagccctttttaaatccattcaaaaaaattaaaggttttagatacttgtacaataagaatgaatctaaatttaccagccagatatttttatgatttgtatggcagaaaaattgaagatatttcaaaagttcctctgcttgaaaaatgcctgcaaaattccatcacacctttgcgaggactactttgggtctctaagggagaaggtttcagcccctcaggagctaagatgtacatccaaggagttcttttggccctgtaccaacgattaaagtctgcaaaaaaatattataaacagagaactgggtctcactatgttgcccaggcaagcctcaatctcctgtgctcaagggatcctcctgcctcagccttccgagttgctgagactacagttgaacctggtcatgaatgaacagaaggagaaaattacagaaaaagtcattctttcaatgacggcaaaggaacaccataaggaacaggaagaagtgagcaggctgattgatgaattgcagacagctatcaaaagtaacataggtcatctctgtaaacttggcccccaattacaggctgagcaggagcaattctcctcttatgtctaccaacacattaaaagccttccagcaaacacgcttgtcccaggaggcctgcagcttaaggtatttgaaaatggtaaaaacactggagagatctctgttggtatcagtaaaaaagatttgggatcggatagcccaattcaaactgaccatatgatggaaagattacttctcaagattcatcaaaggcttcaaggttcttccatcaacccaccaggcctcaattattcttcaatgcggctttttgatgagaatggccaagaaattaagaatccactttcgctgaagaatgagcaaaaaatttgggtctcttatggtagagcatacagatctccactaaatcttgctttgggtttgacctttgaccgagtgagtgcatttgccagaggtgatatcatggttgcatataagacctttttggatcctaatgctgttctgctacctggatgtggcaattgggaagtttgtgagggatttccaattaatttcaactgtaccagtcaacagatacctgaccagtttgaaaaggtggacttggagaaccattttctacagaacaaggtagatcccaatattgtccttcatgcctctgtttccattggaaagtggagtttctcaggcagtgaagcaagcagcaggagtcaaatagcgccatcgatcctgtggcctgtagccagtgtgtggctgatcaccaagactggaatgatcctgagccgagcgataactcagggctgcctggctattggtcatcctatcagagtcaaggctgctgagggaacatcactagaaggatataaattaatcttacagaaaagacatagtggagatgactctcagaagtgggtgtttggaactgatggttgcatttattcaaaggcttatcctcagtttgttctgacctacctagaggagctaaatgcacaagtagatgtgacccagacagagtatcacattcaccatggtgcctggaccacagctcatcaggaacatggcagaaacttagcagaagaggttctgcaagaaagtgccagcaaccttggtctgaagcaactgccagaaccctcagacacccatttaatgccagaaggttctcttgaggagacgggggagctgacagtagcactggtgaggaaactggaagagaaacatcctaaggcttctgctcagaggtgggccataaaacatgaaggaaccagtaagccaggccagtggaaacattctagagttgaaaatcctctatggaacaagcttacctacatgtggcctgtccttcccagtggccaacttaatgaggcaatgcagacagagcaaggaaggagatagacttggttcctaagttcatgaagcttacagattaagaagtataagctatgagtcaacaaggaagaaacaagaaaaggaaggagacagagttgatgaataaaggagaaggaagggagagagaagaaactcacagaaaaagtttggtgttccagaaatcaaggctatgcattgagccagtttatttagtcatatagtcactgtgaagaaagatcagctgggctgattgtccaaatgggcctgaaaattaagtaaaaatactaaatctaggaaaaccatctaacaaacaacaccctgagtgagactccaattctcctgttagttccttgacaagaaactttcaaaatagaatgatgactaaggaagtatgaacaatatagaaatatggaattatcttggtaatgtctcagactgcattaatactaaaaactatgtacctctcagtggtgacagctgctttgagaactgatttcatgctgtcctcacttttaaatattattcatactaaaaggcaattgataatatttttatgaacaaacagcatttaatatatctagggatatcagtattttttaaatatggtaaagccttattgaaaaccaacattaataaattcttttggtttcttttgtgactaagttcactggaaaaaattagaggaactcaagttattttctcactctatgggggaaaagttgtgaattgaaaaattgtgcttctaaacacttaaaggtaaggagcaatggattttcatattcaaggaaggaattgtggtaaaaagtaagattaaaaagatgtacgattttggaatgagctgttggatagttattttaaagtatctaaattaaaatatatccatttggacgggccatgccagacagaacaaagctaaaagtttattactctattgagagatgataataagtagctaccagaataaagaggggggaaaaggagacgtgggaaggctcaggagagaacattgaagaatatattatattgttaatagcaaatagataaaagaggactaatatagctatgaaacttagattgctggttaagagctggactcccaaaacgaacacatgctctctctcttatgagagagagat

SEQ ID NO: 127968 - DNA, 4758 bp, Homo sapiens
  Payload ID: 5056
  Gene Symbol: DCDC1
  Gene Name: doublecortin domain containing 1
  ENST ID: ENST00000406071
  CDS Start-End: 317-2989
agctttgtgtctctcagtaccatcatggcctctccatgtatctttacagtataccttctgagacctgctgaggatatgactcagcaaatcaccatggtgatgggagaaagccaggttgtgggggcaccagctataacggggtaatacttggaaggcaatttctttctgagaacttgctgcagcctagcttggagtcctggcctggaaagcttgaatatgaaaagtcaggtgggccataaaacatgaaggaaccagtaagccaggccagtggaaacattctagagttgaaaatcctctatggaacaagcttacctacatgtggcctgtccttcccagtggccaacttaatgaggagtttgattggccaatacaaggactgcttgttccgagcagtcctcccatgaagaaacccatctgtaagacaacagagccatatgcccctgtgcgactcagagttttgcagaatggagagaagaataaaaacagatccgttactatccttggtccagatatctcacctggacggaaaacgcagtgcactgagattttaaatttaccttctgcagctcggagattgtacaatgaaaaggggaaggaaatatttgccttaaaagacctgcaaagagatgaactggtgtatgtttcatgtggagaactctggatcaatcctgacctgtccattgctcagcaaaagaaacaaatattcctgaggaacctagaatcagacattgccaaaattcaaatcttctgcagcacacataaaatagaagctcttgttttagaagtccaaagtgacattgtatctggaagcaagcttgctgtgcataaacctgtagcaatttttggagaagagaagcaagttacagaaccggaagaaaagcaaatgcaagaagatcctctaacaacggaaaatgcttccagtgaaattctagattcacacgtaagagctcatcttcgaatgaaggcttgtcacacacttcccaggtatgcctggcaggaaacttcacatgactttgatgaggatgacagtcttccaaagaaaacggaaaaagggctctttgaaaatgtggaaccacagaagaaacacagctgttcaccaaagcatagtaaattgcacaagcattgtcatcagcagttcgaatacagagatgggcagattataagccatgctgctcctcagctagtcttgggggttcaaggtcccaatctccgatcaggcatggaggtggttttggtggagaagaaatctgatggtagtcatcagcgctggatacaccaggaagacagcaggacctttcaccttgtgagtaaccctgaccttgtgctggcagtgtctatgaccaagactagaaatgaagtttgtggctatccagttattgttcagaaatataagccgtacaacaatggagctgccaatcaaaagtggcattacatgaaaaatataaaagcacttgtggcctttcatagcactgccttggataaggaaattacatcagcaaattatgctggtgtctgtacatcatctgtgattaaagaagaaaacattgatcaaccaggatactgttatctctcacctgatggaaagagaaaaactatgctctgcttggcttgtggacaatccatgagaacagagaaaggactgaaacaattgcttccaggggttccattcctctgtatttcaggcaccaagactcagaagcccttcttacaagggcccttcaaggtcatcagtgtggctgaggttgatttgtcgtgtgacaaggctgaaaaaactctaagttactaccaagcacgtctattgtctttacggatgaagacctgcacgcaagctgcatctcacagtggcatggcagccacacaccagaaggcagtgaaaataattgcatacaaaaatggggatgggtatcgtaatgggaagttaattgtggctggaacattccccatgcttcttacagaatgcacggaacaacttgggcttgccagagcagcctccaaagtatataccaaagatggaaccccaatctttaccttgcgtgatttggttttatgggctctagatgaatcctttctccagagagactctgagaaacaaaagcaagatgcagctcctgttggaaaagaacagataattgttgaaaaaaatccaagaatgaaagtgaaaaacagattatttgcaaaatctgtgacatccgatagtttggatggtatagacaagtctttgcttaccctcatcctcagaaatcctattgccatctgggtgtcttgtggtgaaccatttctacctccaaatgctttgcagaaagcagaaaaattagagaaacagaactggctaaaaaaggacagaattttggctgatctagataccatgagacacaaaatgagacagttaaaagggcggcgagtagcggcatgtcagccagccaccatggttcctaccaagagccctgtgcagcccgtggtggttgaaggaggctggaccgaacagactcaacaggaaattaaactcatggaacttataagacatacagaggcacacctttctgaaatccaagaaatggaatccaaaataaattttccaattgcaaccaaacgtatagcagtcaagccgagcaacctgtataagcagcccaacacaaaacgagtgtggatttatctaaatggaggcagacctgaagatggcacttatgcctggggcaaaactatttcagagctgctgcaagactgctcctctcgtctcaaaatgacccacccagctagagcactgtacacccccagtggagagccaattcagtcctgggacgacatagagcgagatatggtcatctgtgtgtctatgggacatggtttcaaaaccccaaaagagttaaaacaactgatggagatcagagcaaattatgccagaatccgaaggcagcagggccctcaagccacagacattgtggtgtcaccatccacgaagctgctgtctctggcacatctccacaattaactcctatcagaaccatcggattttctgctgtatttttctggaaagaaaactttctttacccacttataaacagaagactgtgacaagaaggccaattatttccatcgctgaagactctaaatttggcaaatcttctaaataacaatcctgcatagtttattaaaaaaaattagtcgtaaaatttatccttcaaaaatctgcattttaaataaaccctgacagtgatttctcaagactgtaaagatattagtctgagaatgcaactctaacagactgctctgggcatcttttctctttgccttggccaggcctctcagaattgagtgagcgtgtgactccatttgcacagtgggacagatgagtacaactgaaataaaaagtggaggcctctgcaaaaaataaaaaataaaaaataaatttatccttcaaaataactcagttttttcaatgggcctattttgaagaatgaacattgaaaaatgagacaatatatccataaattcatagtatgacataccataatcgagagcattgttagccatagacattttgtatgccagtgaaatctgtatacattctctaaatttttccagtttatcgtgtggcttattggaaaaaaaaaagcatatacactgactgcatgttttgtctccccaactaaatgataagtgcctagagggcaggaacacccttggttttatttacttgggacagagctctacccacaagggctcactgataaaactcatcagtcccaccccacagcaacatgatggggacatgaggttcagttcttctactcttggcctgagccgcaaaccaaaattacaacagtacaatgggaatagaggatctgctttatagaatttcctttcagtcagctgctcagaaactacaatcctcagagtgaaattaaatggagttatactgggatagtcctctctgcttttcagaggaaagaaacacttctcgaaattgtgcaaatgaaagaaatgtcatggtataaactagacatcttatatccttaaaatatatctttgatgattatacatattggtttcaaatcccaagtttgaagaaacatccaaaagttatgtgaaattacttatagatgaattgacaacatttgagacttcgacaggcaatcatgaagcagttctcaagttgatttggtttatatagctctttaagaatcttttggaaagccataatctcacaaaatacagatatgcaattttttttttttgagatggagtctcactctgttgcccagtctggagttcagtggcgcgatctcagctcactacaagctccccttcccaggttcaagcaattctcctgtctcagcctcctgagtagctgggactacaggcgcctgccaccacacccagctaacttttgtatttttagtagagatggggtttcaccttgttggtcaagctggtctcaaactcctgacctcaggtgatccactcgcctctgcctcccaaagtgctgggattacaggcgtaagccaccacacccagcccaaaaaatgtttgtgcacagaactgtggatgtttgtcacagaactttccaaataaagaagttctgataaaagagaagatatttctcatttccataatctttaaggtgtgggggatacgtaatctggacttctcaaatggatgatttctaaatacgcgtcagatgaagtgattctaactttctctgtagtaatatcttattttgttttattcaaaaacaataaaccatgtagatttattagc

SEQ ID NO: 127969 - DNA, 1706 bp, Homo sapiens
  Payload ID: 5056
  Gene Symbol: DCDC1
  Gene Name: doublecortin domain containing 1
  Uniprot ID: P59894
  ENST ID: ENST00000452803
  CDS Start-End: 203-1267
agaagcgacgctccgcccaccccgacgcggtctctatggtaaccggtcaccgcttctatggagtggcgtttactaccaattgcaaataagaaaattccagattccattccaagatggccaaataggaacagctccagcctgcagctcccagcgtgattaatgtagaagatgggtgatttctgcatttccaactaagctgaaaatggcaaaaacaggagcagaagatcacagagaagcactatctcagtcttccttatccctcttgactgaagcaatggaagtattacagcaaagtagccctgaaggcactttggatgggaatactgtaaacccaatttacaaatatattttgaatgatttaccaagagagtttatgtcatcccaggcaaaagcagttattaaaactactgatgattatttgcagtctcagtttggccccaacagactcgtgcattcagcagcagtatcagaagggtcaggacttcaagattgctccacacatcaaacagcatcagatcacagccatgatgaaatatcagacctagatagctacaaatcaaacagtaaaaacaattcttgttctatatcagcatccaagagaaacagacctgtcagtgctccagtgggtcaactgagggttgcagagttctcttctttaaaatttcagtcagcccggaattggcagaaattgtctcaaagacacaaacttcaaccaagagtgattaaagtaacagcttacaaaaatggatctagaacagtctttgccagagttactgtaccaaccatcaccttgctgctggaggagtgcacagaaaagctgaatctgaacatggccgcaagacgagtgttcttggcagacggcaaggaagccctcgaacctgaagatataccccatgaagccgatgtttatgtttcaacgggagagccctttttaaatccattcaaaaaaattaaagaccatctgttgttaattaagaaagtaacttggacaatgaatgggttgatgcttcctactgatatcaaaagacggaaaaccaagcctgttctttctattagaatgaagaaacttactgagaggacctcagtccgaattctgttctttaagaatggcatggggcaggatgggcatgagattacagtgggaaaagaaacaatgaaaaaggttttagatacttgtacaataagaatgaatctaaatttaccagccagatatttttatgatttgtatggcagaaaaattgaagatatttcaaaaggaaagcactgactctgagacgtgatacttcatggatgccagaggcattcggattcatgactcgtgcttcacgtatcccagaagtgtgctattatcacattttaatgcatgccttgccctctgtttttgcatccttataaaagcttatgccagctgaaattagcctgtgcaaccactaacatgtggaagcattacaagttcactggacttaaaatatttaaagaagctaatcctgttggaggaacttccagtctgtagcaccctagtcacttaacattaggtttttgaacttcttttttctttgtttctatgatgttgtgcatcaaatgattgagatccctaaacttttgtgttggatggttttctgaacttcaacttgggaaaggtcaagttttatgtgaaagttatcttttaatttaaacaaataaatgctgatactcttttgattcga

SEQ ID NO: 127970 - DNA, 3184 bp, Homo sapiens
  Payload ID: 5056
  Gene Symbol: DCDC1
  Gene Name: doublecortin domain containing 1
  ENST ID: ENST00000444572
  CDS Start-End: 1-2455
gtgcactgagattttaaatttaccttctgcagctcggagattgtacaatgaaaaggggaaggaaatatttgccttaaaagacctgcaaagagatgaactggtgtatgtttcatgtggagaactctggatcaatcctgacctgtccattgctcagcaaaagaaacaaatattcctgaggaacctagaatcagacattgccaaaattcaaatcttctgcagcacacataaaatagaagctcttgttttagaagtccaaagtgacattgtatctggaagcaagcttgctgtgcataaacctgtagcaatttttggagaagagaagcaagttacagaaccggaagaaaagcaaatgcaagaagatcctctaacaacggaaaatgcttccagtgaaattctagattcacacgtaagagctcatcttcgaatgaaggcttgtcacacacttcccaggtatgcctggcaggaaacttcacatgactttgatgaggatgacagtcttccaaagaaaacggaaaaagggctctttgaaaatgtggaaccacagaagaaacacagctgttcaccaaagcatagtaaattgcacaagcattgtcatcagcagttcgaatacagagatgggcagattataagccatgctgctcctcagctagtcttgggggttcaaggtcccaatctccgatcaggcatggaggtggttttggtggagaagaaatctgatggtagtcatcagcgctggatacaccaggaagacagcaggacctttcaccttgtgagtaaccctgaccttgtgctggcagtgtctatgaccaagactagaaatgaagtttgtggctatccagttattgttcagaaatataagccgtacaacaatggagctgccaatcaaaagtggcattacatgaaaaatataaaagcacttgtggcctttcatagcactgccttggataaggaaattacatcagcaaattatgctggtgtctgtacatcatctgtgattaaagaagaaaacattgatcaaccaggatactgttatctctcacctgatggaaagagaaaaactatgctctgcttggcttgtggacaatccatgagaacagagaaaggactgaaacaattgcttccaggggttccattcctctgtatttcaggcaccaagactcagaagcccttcttacaagggcccttcaaggtcatcagtgtggctgaggttgatttgtcgtgtgacaaggctgaaaaaactctaagttactaccaagcacgtctattgtctttacggatgaagacctgcacgcaagctgcatctcacagtggcatggcagccacacaccagaaggcagtgaaaataattgcatacaaaaatggggatgggtatcgtaatgggaagttaattgtggctggaacattccccatgcttcttacagaatgcacggaacaacttgggcttgccagagcagcctccaaagtatataccaaagatggaaccccaatctttaccttgcgtgatttggttttatgggctctagatgaatcctttctccagagagactctgagaaacaaaagcaagatgcagctcctgttggaaaagaacagataattgttgaaaaaaatccaagaatgaaagtgaaaaacagattatttgcaaaatctgtgacatccgatagtttggatggtatagacaagtctttgcttaccctcatcctcagaaatcctattgccatctgggtgtcttgtggtgaaccatttctacctccaaatgctttgcagaaagcagaaaaattagagaaacagaactggctaaaaaaggacagaattttggctgatctagataccatgagacacaaaatgagacagttaaaagggcggcgagtagcggcatgtcagccagccaccatggttcctaccaagagccctgtgcagcccgtggtggttgaaggaggctggaccgaacagactcaacaggaaattaaactcatggaacttataagacatacagaggcacacctttctgaaatccaagaaatggaatccaaaataaattttccaattgcaaccaaacgtatagcagtcaagccgagcaacctgtataagcagcccaacacaaaacgagtgtggatttatctaaatggaggcagacctgaagatggcacttatgcctggggcaaaactatttcagagctgctgcaagactgctcctctcgtctcaaaatgacccacccagctagagcactgtacacccccagtggagagccaattcagtcctgggacgacatagagcgagatatggtcatctgtgtgtctatgggacatggtttcaaaaccccaaaagagttaaaacaactgatggagatcagagcaaattatgccagaatccgaaggcagcagggccctcaagccacagacattgtggtgtcaccatccacgaagctgctgtctctggcacatctccacaattaactcctatcagaaccatcggattttctgctgtatttttctgagttcttggttgcaagcaacagaaatctatcatttacaacaaaagcaacgaggagattacatgaagcgaaagagggggctcacagaattgaagggatgccggagaacaagaagctgaagaaaatctcaacattgaaggagccttggacaaccacctaatcctatattcattgaatagttgaactgtatccacccggcgtaatacccatggcaactggtcttccacatatgatgaaatagcctctgagaggttaagtcactcacccaaaatttccactgccaggaagtggtagtgatgggattcaaacctgggtggccctgagaccagagcttccgctctacccacttcactatacttctcttactacaggtacacagcccttttatctctgctttcctgaagcagcctttgtaagtggaaggattgtactgaaggctcagcagcaatagagctaatgaaatggaagctgggcagtgctgagtccctgggtcacagttaccgagaggaaaagtgggctggctgagatttcatcccaggctgcctgctacgaagctcctcatctgcctccctcgaatcaagtgctacatccaataatagggactaaacccacatctgtagcttctgagtcgagagatctgaatagagaaatcagcagttaaaataaaattaaaatagctctgaacatttaa

SEQ ID NO: 127971 - DNA, 5352 bp, Homo sapiens
  Payload ID: 5056
  Gene Symbol: DCDC1
  Gene Name: doublecortin domain containing 1
  ENST ID: ENST00000597505
  CDS Start-End: 1-5352
atggcaaaaacaggagcagaagatcacagagaagcactatctcagtcttccttatccctcttgactgaagcaatggaagtattacagcaaagtagccctgaaggcactttggatgggaatactgtaaacccaatttacaaatatattttgaatgatttaccaagagagtttatgtcatcccaggcaaaagcagttattaaaactactgatgattatttgcagtctcagtttggccccaacagactcgtgcattcagcagcagtatcagaagggtcaggacttcaagattgctccacacatcaaacagcatcagatcacagccatgatgaaatatcagacctagatagctacaaatcaaacagtaaaaacaattcttgttctatatcagcatccaagagaaacagacctgtcagtgctccagtgggtcaactgagggttgcagagttctcttctttaaaatttcagtcagcccggaattggcagaaattgtctcaaagacacaaacttcaaccaagagtgattaaagtaacagcttacaaaaatggatctagaacagtctttgccagagttactgtaccaaccatcaccttgctgctggaggagtgcacagaaaagctgaatctgaacatggccgcaagacgagtgttcttggcagacggcaaggaagccctcgaacctgaagatataccccatgaagccgatgtttatgtttcaacgggagagccctttttaaatccattcaaaaaaattaaagaccatctgttgttaattaagaaagtaacttggacaatgaatgggttgatgcttcctactgatatcaaaagacggaaaaccaagcctgttctttctattagaatgaagaaacttactgagaggacctcagtccgaattctgttctttaagaatggcatggggcaggatgggcatgagattacagtgggaaaagaaacaatgaaaaaggttttagatacttgtacaataagaatgaatctaaatttaccagccagatatttttatgatttgtatggcagaaaaattgaagatatttcaaaagttcctctgcttgaaaaatgcctgcaaaattccatcacacctttgcgaggactactttgggtctctaagggagaaggtttcagcccctcaggagctaagatgtacatccaaggagttcttttggccctgtaccaacgattaaagtctgcaaaaaaatattataaacagttgaacctggtcatgaatgaacagaaggagaaaattacagaaaaagtcattctttcaatgacggcaaaggaacaccataaggaacaggaagaagtgagcaggctgattgatgaattgcagacagctatcaaaagtaacataggtcatctctgtaaacttggcccccaattacaggctgagcaggagcaattctcctcttatgtctaccaacacattaaaagccttccagcaaacacgcttgtcccaggaggcctgcagcttaaggtatttgaaaatggtaaaaacactggagagatctctgttggtatcagtaaaaaagatttgggatcggatagcccaattcaaactgaccatatgatggaaagattacttctcaagattcatcaaaggcttcaaggttcttccatcaacccaccaggcctcaattattcttcaatgcggctttttgatgagaatggccaagaaattaagaatccactttcgctgaagaatgagcaaaaaatttgggtctcttatggtagagcatacagatctccactaaatcttgctttgggtttgacctttgaccgagtgagtgcatttgccagaggtgatatcatggttgcatataagacctttttggatcctaatgctgttctgctacctggatgtggcaattgggaagtttgtgagggatttccaattaatttcaactgtaccagtcaacagatacctgaccagtttgaaaaggtggacttggagaaccattttctacagaacaaggtagatcccaatattgtccttcatgcctctgtttccattggaaagtggagtttctcaggcagtgaagcaagcagcaggagtcaaatagcgccatcgatcctgtggcctgtagccagtgtgtggctgatcaccaagactggaatgatcctgagccgagcgataactcagggctgcctggctattggtcatcctatcagagtcaaggctgctgagggaacatcactagaaggatataaattaatcttacagaaaagacatagtggagatgactctcagaagtgggtgtttggaactgatggttgcatttattcaaaggcttatcctcagtttgttctgacctacctagaggagctaaatgcacaagtagatgtgacccagacagagtatcacattcaccatggtgcctggaccacagctcatcaggaacatggcagaaacttagcagaagaggttctgcaagaaagtgccagcaaccttggtctgaagcaactgccagaaccctcagacacccatttaatgccagaaggttctcttgaggagacgggggagctgacagtagcactggtgaggaaactggaagagaaacatcctaaggcttctgctcagaggtgggccataaaacatgaaggaaccagtaagccaggccagtggaaacattctagagttgaaaatcctctatggaacaagcttacctacatgtggcctgtccttcccagtggccaacttaatgaggagtttgattggccaatacaaggactgcttgttccgagcagtcctcccatgaagaaacccatctgtaagacaacagagccatatgcccctgtgcgactcagagttttgcagaatggagagaagaataaaaacagatccgttactatccttggtccagatatctcacctggacggaaaacgcagtgcactgagattttaaatttaccttctgcagctcggagattgtacaatgaaaaggggaaggaaatatttgccttaaaagacctgcaaagagatgaactggtgtatgtttcatgtggagaactctggatcaatcctgacctgtccattgctcagcaaaagaaacaaatattcctgaggaacctagaatcagacattgccaaaattcaaatcttctgcagcacacataaaatagaagctcttgttttagaagtccaaagtgacattgtatctggaagcaagcttgctgtgcataaacctgtagcaatttttggagaagagaagcaagttacagaaccggaagaaaagcaaatgcaagaagatcctctaacaacggaaaatgcttccagtgaaattctagattcacacgtaagagctcatcttcgaatgaaggcttgtcacacacttcccaggtatgcctggcaggaaacttcacatgactttgatgaggatgacagtcttccaaagaaaacggaaaaagggctctttgaaaatgtggaaccacagaagaaacacagctgttcaccaaagcatagtaaattgcacaagcattgtcatcagcagttcgaatacagagatgggcagattataagccatgctgctcctcagctagtcttgggggttcaaggtcccaatctccgatcaggcatggaggtggttttggtggagaagaaatctgatggtagtcatcagcgctggatacaccaggaagacagcaggacctttcaccttgtgagtaaccctgaccttgtgctggcagtgtctatgaccaagactagaaatgaagtttgtggctatccagttattgttcagaaatataagccgtacaacaatggagctgccaatcaaaagtggcattacatgaaaaatataaaagcacttgtggcctttcatagcactgccttggataaggaaattacatcagcaaattatgctggtgtctgtacatcatctgtgattaaagaagaaaacattgatcaaccaggatactgttatctctcacctgatggaaagagaaaaactatgctctgcttggcttgtggacaatccatgagaacagagaaaggactgaaacaattgcttccaggggttccattcctctgtatttcaggcaccaagactcagaagcccttcttacaagggcccttcaaggtcatcagtgtggctgaggttgatttgtcgtgtgacaaggctgaaaaaactctaagttactaccaagcacgtctattgtctttacggatgaagacctgcacgcaagctgcatctcacagtggcatggcagccacacaccagaaggcagtgaaaataattgcatacaaaaatggggatgggtatcgtaatgggaagttaattgtggctggaacattccccatgcttcttacagaatgcacggaacaacttgggcttgccagagcagcctccaaagtatataccaaagatggaaccccaatctttaccttgcgtgatttggttttatgggctctagatgaatcctttctccagagagactctgagaaacaaaagcaagatgcagctcctgttggaaaagaacagataattgttgaaaaaaatccaagaatgaaagtgaaaaacagattatttgcaaaatctgtgacatccgatagtttggatggtatagacaagtctttgcttaccctcatcctcagaaatcctattgccatctgggtgtcttgtggtgaaccatttctacctccaaatgctttgcagaaagcagaaaaattagagaaacagaactggctaaaaaaggacagaattttggctgatctagataccatgagacacaaaatgagacagttaaaagggcggcgagtagcggcatgtcagccagccaccatggttcctaccaagagccctgtgcagcccgtggtggttgaaggaggctggaccgaacagactcaacaggaaattaaactcatggaacttataagacatacagaggcacacctttctgaaatccaagaaatggaatccaaaataaattttccaattgcaaccaaacgtatagcagtcaagccgagcaacctgtataagcagcccaacacaaaacgagtgtggatttatctaaatggaggcagacctgaagatggcacttatgcctggggcaaaactatttcagagctgctgcaagactgctcctctcgtctcaaaatgacccacccagctagagcactgtacacccccagtggagagccaattcagtcctgggacgacatagagcgagatatggtcatctgtgtgtctatgggacatggtttcaaaaccccaaaagagttaaaacaactgatggagatcagagcaaattatgccagaatccgaaggcagcagggccctcaagccacagacattgtggtgtcaccatccacgaagctgctgtctctggcacatctccacaattaa

SEQ ID NO: 127972 - DNA, 3684 bp, Homo sapiens
  Payload ID: 5057
  Gene Symbol: DCDC2
  Gene Name: doublecortin domain containing 2
  Uniprot ID: Q9UHG0
  ENST ID: ENST00000378450
  CDS Start-End: 21-710
gaccactgaatgttttctcaatgaaaatgtggaacaactgggggtggtgtggtggtcggaggagggggtgcacaaaaatactatcaactaaaaagggaatccaaatgtctattaaaaataagcatttgattgtaattccagcattcagccacacgatgtcacaattggattttgattttcactgtgtgtttgtctcaatagatgaaggcattttcaaagctggagcagagaggtctgaaacacggggggcagcagaagtccaagaagatgaagatactcaggttgaggttccagtcgatcagaggccagcagaaatagtagacgaggaagaagatggagagaaggcaaacaaggatgcagaacagaaagaagacttttcaggaatgaatggtgaccttgaagaggaaggaggtagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggctgatgtagaccctcaaagaccaccaaggccagaagtaaaaattaccagtccagaagaaaatgaaaacaaccaacaaaacaaggactatgctgccgtggcttagaacatttttaaaaagagagtatatggatcgcaagaaaaatgaagggttatcatacttgaaagataagcacatagttattgctgaatataatgtgacactatggtcgaatactacctacgaattataacattagaagcctagtggaaagaccagataactttaaatggctactaaaggataattacttacttttattgcatgtgttttaaaagtcatatagaaatattaaataagacggacagaggagaatttgcactggaagacaattgccacttgtaaaggatgaaaaataggatcactcttattgtacgctttattataagtttagaaggcagtttattctaaataatttttctctaggaaggcgtagaattttaaagaactggtaataggaaagcatgtactattttcttaaagcaataaactcttgaatgaacagattgcgatttactttcagacataatttggagatggcagtagatcaaaatgtgtccatgacttgttaacatgcctttctttcttcctccttagccaaaatccacctttgaactacaaagacagagcaaggcgttcattttggtgggaggaagcattggttcagagtgttagtgactagtatcgccatgccgtcacttaaatgctttcaggcttgcatgcttgtggctccaatggcgcacactcaggaaggaattgtaaaggagcacccagttatattataaagcctggatgtatggtttgcagataatggaaatcctgtggattttcactgatccagtctatctttaccaatagtatctctctcttctcccttatgttattagagaacctgatattggctattccaaagattaaattattttcaaatagttttcaacaaaaataaaagtgtattaggaagaaaaaagtagactatatgaagagtttgtgactgctcaatttaacttgttttttgccttatttctattaagactgttttactatgtttttgccctagggatatcagcaaatatttatttttcctagcatgatatagttagaatttcaagcagatttctttgtaattagaaggcatctgatagaaattgtaaaactttagaagttattataatgaaaccaattcctgaatcacaacttcatggactgactaaattgatttatagttgccttgtgaggtatgtatggggaaaacataaaaacataattaaaacataatttcgtcctttttatgaattcttaagagatgttcttccataaatatagaaataatatatttttcttaaaggatatatttttaattatgtggaagttgtaagcttgaaattttaacttctagtgcttttctaaaattcacaattacaagtttaaaacattttttctcttccaggtttcatttggaataaagagttggcagttatataaagcacttaataatactatagaaaatagatgtgttttttcttaatatgattttggtattttccacagatcagaagtgtaaacagagagataatgtaacagtatttggaagagataatgacacaaggatatagtgatctgggagcatgaattagaaacagggtactatgtttctggtgtaaaatctaaattgtgctttctactagcgttactttttcaaatgggatgatataaagcactgtgggctataagcaacaatcttgggttggtaggcaaatagaccaattgatctttattattattattattattattattattattttttgagatgaagtcttgctcttgtcgcccaggctgggtgcagtggcatgatcttggcttactgcaacctctgcctcctgggttcaagcacctgagcctcccgagtagctgggattacaggcatctgccaccacacctggctaatttttgtattttttgtagagacagatgtttcaccatgttggccaggctggtctcaaactcctgacctcaggtgatccgcccgcctttgcatcccaaaatgctgggattacaggtgtgagccacagcacccggtcccagttggtcttttaatattaaatttgtgcactattactgggtctggagttaatgatttcaaatagtttctaaaaataactgattaaatgtaagaaattataactaattatcaaggtgattctcttttgtttcttcaatggagagtttctctttctcttttcctcctctaataaaaatatttctttttttcctgtccttttattcattatattatgaaacttaggttttaggaaacaccttaagcgtcattttaatgaagcacaacattgatattttacatgaataataacgtttggtattttaaatatacttcaagggggtaataagccacaataactgtaccaaaaaaacttaaaaatggggacatattcatcccttgtgtgtgcatattttaccacttgttgacaagatacaattgtgacctactttgaggggatgaataacgacttatcactttaagacactttgcaaacatgttactaaaaaaaggtgcctagccaaggaaaaaaccattcacttggaattaaaattgtggatgtcacttcagagatgactttaacataaatgctgaaagttcattcacctcacaaatgtggcagttttctctgtggagaatggtggtctccgtggcagactggctctccaaattaaatgaaactcattgacagacctgggaccttttatgtgagtggacagacaagatcttggtttggcttcatgtactgttttctagagagagtgctacgaaaaacttatgatgcttttatgtgataaccaatataatgctttaatatgttaattctttgtgatgctatatacatagtttttatagttttatgaaaccactttgttaaacttatctggattttaagacacttgtaaacaaatggtttgttagtaaaattggggcattaagagttttacagagcaaataaagaagattttgacaaaagtc

SEQ ID NO: 127973 - DNA, 4707 bp, Homo sapiens
  Payload ID: 5057
  Gene Symbol: DCDC2
  Gene Name: doublecortin domain containing 2
  Uniprot ID: Q9UHG0
  ENST ID: ENST00000378454
  CDS Start-End: 303-1733
gtccaccttgattctgcccgtagcaggtgaacctggtgtggtgcgcgcactgcgggtcctgattggctgtgcacgccacggtgaaaaacttgagcgtctactccgagtcctgcaagctcctagtgtctcctctgggtggacgcctaggcgcacggccgttacttctctttcacctgtggattcgtcagtttctcgttcgtttcaggaggcgatcccgcgccctgggtgcggtgaggccgctgggacagcggaggtgcctcccgacgcgaagcagcgagctgaggcggcggccagcggggaagatgagcggcagcagcgccaggtccagccacctgtctcagcccgtcgtgaagagcgtgcttgtgtaccgcaacggggaccccttctacgcggggcgccgcgtcgtcatccatgagaagaaggtgtccagcttcgaagtcttcctgaaggaggtgaccggcggcgttcaggcaccctttggggccgtcaggaacatctacaccccgcggactggccaccgaatccggaagctagaccagatccagagcgggggcaattacgtggctggaggccaggaagccttcaagaaactcaattacttggacataggagaaatcaagaaaagaccaatggaagttgttaatacagaggtaaaaccagtaatccatagcaggatcaacgtgtcagctcgctttagaaaaccgcttcaggagccgtgcactatcttcttgattgcaaatggagacctcataaacccagcttctcgcctccttatccccagaaaaaccttgaatcagtgggatcatgtactacaaatggtcacagaaaaaatcactctgaggagcggggctgttcacaggctttatactttagaaggaaaacttgttgagagtggagcagagttggagaatgggcagttttatgtggctgttggcagagataagtttaagaaactgccttacagtgagttactttttgacaagtcaacgatgagaaggccttttggtcagaaagcttcttcactacctcctattgtaggatccagaaagtctaaagggagtggaaatgatcgccactctaagtcaacagttggatccagtgacaactcatctcctcagcccctgaagaggaaagggaaaaaagaagacgtgaattcagaaaaactgacgaaattgaaacaaaatgtaaaattaaagaattcacaagaaaccattccaaatagtgatgaaggcattttcaaagctggagcagagaggtctgaaacacggggggcagcagaagtccaagaagatgaagatactcaggttgaggttccagtcgatcagaggccagcagaaatagtagacgaggaagaagatggagagaaggcaaacaaggatgcagaacagaaagaagacttttcaggaatgaatggtgaccttgaagaggaaggaggtagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggctgatgtagaccctcaaagaccaccaaggccagaagtaaaaattaccagtccagaagaaaatgaaaacaaccaacaaaacaaggactatgctgccgtggcttagaacatttttaaaaagagagtatatggatcgcaagaaaaatgaagggttatcatacttgaaagataagcacatagttattgctgaatataatgtgacactatggtcgaatactacctacgaattataacattagaagcctagtggaaagaccagataactttaaatggctactaaaggataattacttacttttattgcatgtgttttaaaagtcatatagaaatattaaataagacggacagaggagaatttgcactggaagacaattgccacttgtaaaggatgaaaaataggatcactcttattgtacgctttattataagtttagaaggcagtttattctaaataatttttctctaggaaggcgtagaattttaaagaactggtaataggaaagcatgtactattttcttaaagcaataaactcttgaatgaacagattgcgatttactttcagacataatttggagatggcagtagatcaaaatgtgtccatgacttgttaacatgcctttctttcttcctccttagccaaaatccacctttgaactacaaagacagagcaaggcgttcattttggtgggaggaagcattggttcagagtgttagtgactagtatcgccatgccgtcacttaaatgctttcaggcttgcatgcttgtggctccaatggcgcacactcaggaaggaattgtaaaggagcacccagttatattataaagcctggatgtatggtttgcagataatggaaatcctgtggattttcactgatccagtctatctttaccaatagtatctctctcttctcccttatgttattagagaacctgatattggctattccaaagattaaattattttcaaatagttttcaacaaaaataaaagtgtattaggaagaaaaaagtagactatatgaagagtttgtgactgctcaatttaacttgttttttgccttatttctattaagactgttttactatgtttttgccctagggatatcagcaaatatttatttttcctagcatgatatagttagaatttcaagcagatttctttgtaattagaaggcatctgatagaaattgtaaaactttagaagttattataatgaaaccaattcctgaatcacaacttcatggactgactaaattgatttatagttgccttgtgaggtatgtatggggaaaacataaaaacataattaaaacataatttcgtcctttttatgaattcttaagagatgttcttccataaatatagaaataatatatttttcttaaaggatatatttttaattatgtggaagttgtaagcttgaaattttaacttctagtgcttttctaaaattcacaattacaagtttaaaacattttttctcttccaggtttcatttggaataaagagttggcagttatataaagcacttaataatactatagaaaatagatgtgttttttcttaatatgattttggtattttccacagatcagaagtgtaaacagagagataatgtaacagtatttggaagagataatgacacaaggatatagtgatctgggagcatgaattagaaacagggtactatgtttctggtgtaaaatctaaattgtgctttctactagcgttactttttcaaatgggatgatataaagcactgtgggctataagcaacaatcttgggttggtaggcaaatagaccaattgatctttattattattattattattattattattattttttgagatgaagtcttgctcttgtcgcccaggctgggtgcagtggcatgatcttggcttactgcaacctctgcctcctgggttcaagcacctgagcctcccgagtagctgggattacaggcatctgccaccacacctggctaatttttgtattttttgtagagacagatgtttcaccatgttggccaggctggtctcaaactcctgacctcaggtgatccgcccgcctttgcatcccaaaatgctgggattacaggtgtgagccacagcacccggtcccagttggtcttttaatattaaatttgtgcactattactgggtctggagttaatgatttcaaatagtttctaaaaataactgattaaatgtaagaaattataactaattatcaaggtgattctcttttgtttcttcaatggagagtttctctttctcttttcctcctctaataaaaatatttctttttttcctgtccttttattcattatattatgaaacttaggttttaggaaacaccttaagcgtcattttaatgaagcacaacattgatattttacatgaataataacgtttggtattttaaatatacttcaagggggtaataagccacaataactgtaccaaaaaaacttaaaaatggggacatattcatcccttgtgtgtgcatattttaccacttgttgacaagatacaattgtgacctactttgaggggatgaataacgacttatcactttaagacactttgcaaacatgttactaaaaaaaggtgcctagccaaggaaaaaaccattcacttggaattaaaattgtggatgtcacttcagagatgactttaacataaatgctgaaagttcattcacctcacaaatgtggcagttttctctgtggagaatggtggtctccgtggcagactggctctccaaattaaatgaaactcattgacagacctgggaccttttatgtgagtggacagacaagatcttggtttggcttcatgtactgttttctagagagagtgctacgaaaaacttatgatgcttttatgtgataaccaatataatgctttaatatgttaattctttgtgatgctatatacatagtttttatagttttatgaaaccactttgttaaacttatctggattttaagacacttgtaaacaaatggtttgttagtaaaattggggcattaagagttttacagagcaaataaagaagattttgacaaaagtc

SEQ ID NO: 127974 - DNA, 339 bp, Homo sapiens
  Payload ID: 5057
  Gene Symbol: DCDC2
  Gene Name: doublecortin domain containing 2
  ENST ID: ENST00000436313
  CDS Start-End: 1-266
gcgtcgtcatccatgagaagaaggtgtccagcttcgaagtcttcctgaaggaggtgaccggcggcgttcaggcaccctttggggccgtcaggaacatctacaccccgcggactggccaccgaatccggaagctagaccagatccagagcgggggcaattacgtggctggaggccaggaagccttcaagaaactcaattacttggacataggagaaatcaagaaaagaccaatggaagttgttaatacagagctacatgttctctgattgaaatccatgggaaggttccctgtcaagtgagaagattctgagcgttgttaaataaatctttaccaaagct

SEQ ID NO: 127975 - DNA, 1349 bp, Homo sapiens
  Payload ID: 5058
  Gene Symbol: DCDC2B
  Gene Name: doublecortin domain containing 2B
  Uniprot ID: A2VCK2
  ENST ID: ENST00000409358
  CDS Start-End: 1-1050
atggcaggtggcagtccagcagccaagagggtagtggtgtaccggaatggggacccattcttcccaggctcccagctggtggtgactcaacgccgcttccccaccatggaggccttcctctgcgaggtgacatcagctgtgcaggccccactggctgtgcgtgccctctacacaccttgtcatggccaccctgtcaccaacctggcagacttgaagaacagagggcagtatgtggccgctggatttgaacgattccacaagctccactatttaccccatagagggaaggacccaggtgggaagagctgcagactacaaggtcctcccgtgactcgccacttgtgtgatggggccattggacggcagctgcctgcaggtgctcccagctatatccatgtgttcaggaatggggacctggtaagtcccccatttagtctgaagctgtcccaggctgccagccaggactgggaaactgtgttgaagctcctgactgagaaggtcaagttgcagagtggggctgtgtgcaaactctgcaccctagaggggctcccactgtcagcagggaaggagctggtaactggccattactatgtggctgtcggagaggatgagttcaaggaccttccctatctggagctgctggtgcccagcccctccctgcccaggggctgctggcaacctccaggctcgaagtctaggccccacaggcagggggcccaaggccacagggcccaggtaacccagccctctccaaaggaaccagaccgaattaagccatctgctttctatgccagaccccagcagaccattcagccaagaagcaagctccccacactctcattcccatcaggagttataggagtatatggagctccccaccgaaggaaggagacagcgggggccctggaagtagcagatgatgaagacactcagacagaggagcccttggatcagagggcagcacagatagtggaagaggccttgtccctggaaaaccagcctggggctggggctgctatctcagcctcagccccagctctgccatcttgagagccagcagctccagagggcaactggggaccactactctggccaccttttgtccttagcctccagcagcttgttcctcaggagccagcacctccgctgggctcacagggtacactgcggcctcctcagccctccccgttctcctgctcctaaacccacagcccagccttcccttcctctgagcagagcagccctggctgtgggggctatttccttatgggattctctggccagagaaaggagtagctgactaagcctgggagagggtttgtcacaataaaagaatacttactaacctc

SEQ ID NO: 127976 - DNA, 1480 bp, Homo sapiens
  Payload ID: 5059
  Gene Symbol: DCDC2C
  Gene Name: doublecortin domain containing 2C
  Uniprot ID: A8MYV0
  ENST ID: ENST00000399143
  CDS Start-End: 161-1255
gtccagcccccgtcccgtccccgtcccgtccccgtcctgcgccagcggctggagcggacctcccgtcggcggtgcccgggcctgggcgcggctctgcaggcgtcgctgcccgcgctgccgcagcctctcggccccggcgagcgaggagcggggcgcggctatgggaacccgcgggccctccgcgccggtggacaccacgcccgccaagaccatcgtggtgtaccgcaacggggacccgttctacgtgggcaagaagttcgtgctgtcgcggcgccgcgcggccaccttcgaggcgctgctggagcagctcacggagcaggtggacgtcccgttcggcgtgcgccgcctcttcacgcccacgcgtgggcaccgggtgctggggctggacgcgctgcaggcgggcggcaagtacgtggcggcgggccgcgagcgcttcaaggagctcgattatattcatatagttccccgaaaacctgcaaagataaggaagttgaaggaaatcaaaccagtggtgcattgtgatataaatgtgccttccaagtggcaaacatatcatcgtatatctcgacatataaatgtttttacaaatggaagattatttattccacctgcaaaaatcattatacccaaatttagtctgtccgattgggacatcgtgctggccacgatcggagaaaaagtcttccctctaggaggcgttcggaaattatttacaatgaatgggcatcttttgggcgactcaaaggatttgcaagacaatcacttttatgttgctgtgggactggagaccttcaaatattttccttactggaagtctccaagggtgcccagtgaggtccaacaaaggtatgcgaatgttgaaaaaaactcacagagaaagaaaaaagtggactccaaaggaaaagaaccttgtaaatatgatggcataccccctaaaacacaggattctgtttattatgccaaagaagaaaagaagaaaacattggcagaacctttagtccaaaggggtgcagaaggtgacgtgtataaagcaccgactcctagcaaggaaacccaaggggcgctggacgtcaaagaggagcacaatgtgcagctggaggtgcctgtggaccagagacaagctgagatagttaaagaagatgaagagatacatgagaacacccctgattttgagggcaacaaggataaagaagatgcaaggctttgtgaagacgttgaaagaaagatggcccgggagtggaaacctgtagattaacaaaaccacctttattattacctgaagtccacttttcttcaaccatggggcttccacgtcacatatggacattttaacagcaagaaaatcacatgtggggtgaaactaaagccccacacagtggtgtcttctcgaaagccaaagacgaggtttcataattgagctccatttcttcttattccctttctcagtgatatttctttttagtaaacattttaaagaatg

SEQ ID NO: 127977 - DNA, 895 bp, Homo sapiens
  Payload ID: 5059
  Gene Symbol: DCDC2C
  Gene Name: doublecortin domain containing 2C
  ENST ID: ENST00000423741
  CDS Start-End: 1-895
cgccgcgcggccaccttcgaggcgctgctggagcagctcacggagcaggtggacgtcccgttcggcgtgcgccgcctcttcacgcccacgcgtgggcaccgggtgctggggctggacgcgctgcaggcgggcggcaagtacgtggcggcgggccgcgagcgcttcaaggagctcgattatattcatatagttccccgaaaacctgcaaagataaggaagttgaaggaaatcaaaccagtggtgcattgtgatataaatgtgccttccaagtggcaaacatatcatcgtatatctcgacatataaatgtttttacaaatggaagattatttattccacctgcaaaaatcattatacccaaatttagtctgtccgattgggacatcgtgctggccacgatcggagaaaaagtcttccctctaggaggcgttcggaaattatttacaatgaatgggcatcttttgggcgactcaaaggatttgcaagacaatcacttttatgttgctgtgggactggagaccttcaaatattttccttactggaagtctccaagggtgcccagtgaggtccaacaaaggtatgcgaatgttgaaaaaaactcacagagaaagaaaaaagtggactccaaaggaaaagaaccttgtaaatatgatggcataccccctaaaacacaggattctgtttattatgccaaagaagaaaagaagaaaacattggcagaacctttagtccaaaggggtgcagaaggtgacgtgtataaagcaccgactcctagcaaggaaacccaaggggcgctggacgtcaaagaggagcacaatgtgcagctggaggtgcctgtggaccagagacaagctgagatagttaaagaagatgaagagatacatgagaacacccctg

SEQ ID NO: 127978 - DNA, 5703 bp, Homo sapiens
  Payload ID: 5060
  Gene Symbol: DCLK1
  Gene Name: doublecortin-like kinase 1
  Uniprot ID: O15075
  ENST ID: ENST00000255448
  CDS Start-End: 213-2402
gcacatccctgcactagtggccgcaaccgaggcgccgcgctccagcagctgctgccgcccagcccggccccgccgccgccccccagccctgcagccccgcagccccggccgcgcccagcccggcgaggacagcaccaggaggcggcccccagcgcggccacaaagacccccggcggcgtctctccgcggaccggtcctacttgaagtccatcatgtccttcggcagagacatggagctggagcacttcgacgagcgggataaggcgcagagatacagccgagggtcgcgggtgaacggcctgccgagcccgacgcacagcgcccactgcagcttctaccgcacccgcacgctgcagacgctcagctccgagaagaaggccaagaaagttcgtttctatcgaaacggagatcgatacttcaaagggattgtgtatgccatctccccagaccggttccgatcttttgaggccctgctggctgatttgacccgaactctgtcggataacgtgaatttgccccagggagtgagaacaatctacaccattgatgggctcaagaagatttccagcctggaccaactggtggaaggagagagttatgtatgtggctccatagagcccttcaagaaactggagtacaccaagaatgtgaaccccaactggtcggtgaacgtcaagaccacctcggcttctcgggcagtgtcttcactggccactgccaaaggaagcccttcagaggtgcgagagaataaggatttcattcggcccaagctggtcaccatcatcagaagtggcgtgaagccacggaaagctgtcaggattctgctgaacaagaaaacggctcattcctttgagcaggtcctcaccgatatcaccgatgccatcaagctggactcgggagtggtgaaacgcctgtacacgttggatgggaaacaggtgatgtgccttcaggacttttttggtgatgatgacatttttattgcatgtggaccggagaagttccgttaccaggatgatttcttgctagatgaaagtgaatgtcgagtggtaaagtccacttcttacaccaaaatagcttcatcatcccgcaggagcaccaccaagagcccaggaccgtccaggcgtagcaagtcccctgcctccaccagctcagttaatggaacccctggtagtcagctctctactccgcgctcaggcaagtcgccaagcccatcacccaccagcccaggaagcctgcggaagcagaggagctctcagcatggcggctcctctacgtcacttgcgtccaccaaagtctgcagctcgatggatgagaacgatggccctggagaagaagtgtcggaggaaggcttccagattccagctacaataacagaacgatataaagtcggaagaacaataggagatggaaattttgctgttgtcaaggaatgtgtagaaagatcgactgctagagagtatgctctgaaaattatcaagaaaagcaaatgtcgaggcaaagagcacatgatccagaatgaagtgtctattttaagaagagtgaagcatcccaatatcgttcttctgattgaggagatggatgtgccaactgaactgtatcttgtcatggaattagtaaaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtgtatgagcaccaagatggcagcaaatcactgaagctgggtgactttggactggccaccattgtagacggccccctgtacacagtctgtggcaccccaacatacgtggctccagaaatcattgcagagactggatacggcctcaaggtggacatctgggcagcaggtgtaatcacttatatcctgctgtgtggtttccctccattccgtggaagtggtgatgaccaggaggtgctttttgatcagattttgatggggcaggtggactttccttctccatactgggataatgtttccgattctgcaaaggagctcattaccatgatgctgttggtcgatgtagatcagcgattttctgctgttcaagtacttgagcatccctgggttaatgatgatggcctcccagaaaatgaacatcagctgtcagtagctggaaagataaagaagcatttcaacacaggccccaagccgaatagcacagcagctggagtttctgtcatagcactggaccacgggtttaccatcaagagatcagggtctttggactactaccagcaaccaggaatgtattggataagaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttcgacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacaattccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctagtgcagtgtctccaggcctgagtttcttctggaacagattccattttagaatggggattcacaggttctgtgcatcaccacagtgctcagagaggattctcctggggtgtcttagaggcaggtgcccaactcaaatgtattcccaaggtttgctgggctctgggatccacgagacaaccagagagggatatctcatgaaatttgcatctggtggctgaacagtacctatgttctctgttttgaatatactttaatacctgagagtcttaaaatttgtgaacaacgtttctatagtcctttattttcaaatgcacattgatcttcacttgctgcatttttactcttcaaccctgaaactatggtctacattaatatggatttttaaatcacatgtcattacttttgcaacaccatcaccaaaattttttgctcttttacatttaggttcatctctgtggtctgtgttgtcctgacatgtaaaaagcatatcgtttattgaggtttttttcccccccttttagagcatccggaagtgataacacgcaaaatcacaaagtagcataaatcagtaaattagttgagttgtttttgggggggaggtgggggtagggggcacagaacaccagaaagagtgttggtgtgtaggtagattccatattaatgaggaacactgaactagttggaaattactgctttctctagaaatataaagcaaagcactattccaaggctatggagtagctctacagcctggcctcaactctaaaagtgtgaagaatgcaatgggcagagacctacctgcagtggactgtcattttcctttctttctctgaattactgctttttctgtgggcattaactatattgctacagcatctagtgtactgagcctgcggtgcatggctcaggccttttcccatcgacgtctagggggactctggaccgtgtgaagctagggggtgtttctcagcacactgcagaagggcagctcagaagaatgcagggcccattcagcatggggatcccagcacatcactgtagaatttgagtgatctatgctgaataaacagtggaatgtgaccagtcaagtagaaatcttgagtaatcagatggaatgcaatctttctaacattaagctaccaagatcctgaatgtcagagatgtactcagagggttaacagacaagcacaaggcatgctgactacattggtgtatccagattgctttgcttttagccagtgctttctaatttttttctcgacattcttgggatagttcaagtttgaaataattaagtggtggtgttctttaaggaatttctataaccaaattgatcttatttttgatttcacttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactgacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaac

SEQ ID NO: 127979 - DNA, 8007 bp, Homo sapiens
  Payload ID: 5060
  Gene Symbol: DCLK1
  Gene Name: doublecortin-like kinase 1
  Uniprot ID: O15075
  ENST ID: ENST00000360631
  CDS Start-End: 213-2435
gcacatccctgcactagtggccgcaaccgaggcgccgcgctccagcagctgctgccgcccagcccggccccgccgccgccccccagccctgcagccccgcagccccggccgcgcccagcccggcgaggacagcaccaggaggcggcccccagcgcggccacaaagacccccggcggcgtctctccgcggaccggtcctacttgaagtccatcatgtccttcggcagagacatggagctggagcacttcgacgagcgggataaggcgcagagatacagccgagggtcgcgggtgaacggcctgccgagcccgacgcacagcgcccactgcagcttctaccgcacccgcacgctgcagacgctcagctccgagaagaaggccaagaaagttcgtttctatcgaaacggagatcgatacttcaaagggattgtgtatgccatctccccagaccggttccgatcttttgaggccctgctggctgatttgacccgaactctgtcggataacgtgaatttgccccagggagtgagaacaatctacaccattgatgggctcaagaagatttccagcctggaccaactggtggaaggagagagttatgtatgtggctccatagagcccttcaagaaactggagtacaccaagaatgtgaaccccaactggtcggtgaacgtcaagaccacctcggcttctcgggcagtgtcttcactggccactgccaaaggaagcccttcagaggtgcgagagaataaggatttcattcggcccaagctggtcaccatcatcagaagtggcgtgaagccacggaaagctgtcaggattctgctgaacaagaaaacggctcattcctttgagcaggtcctcaccgatatcaccgatgccatcaagctggactcgggagtggtgaaacgcctgtacacgttggatgggaaacaggtgatgtgccttcaggacttttttggtgatgatgacatttttattgcatgtggaccggagaagttccgttaccaggatgatttcttgctagatgaaagtgaatgtcgagtggtaaagtccacttcttacaccaaaatagcttcatcatcccgcaggagcaccaccaagagcccaggaccgtccaggcgtagcaagtcccctgcctccaccagctcagttaatggaacccctggtagtcagctctctactccgcgctcaggcaagtcgccaagcccatcacccaccagcccaggaagcctgcggaagcagaggagctctcagcatggcggctcctctacgtcacttgcgtccaccaaagtctgcagctcgatggatgagaacgatggccctggagaagaagtgtcggaggaaggcttccagattccagctacaataacagaacgatataaagtcggaagaacaataggagatggaaattttgctgttgtcaaggaatgtgtagaaagatcgactgctagagagtatgctctgaaaattatcaagaaaagcaaatgtcgaggcaaagagcacatgatccagaatgaagtgtctattttaagaagagtgaagcatcccaatatcgttcttctgattgaggagatggatgtgccaactgaactgtatcttgtcatggaattagtaaaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtgtatgagcaccaagatggcagcaaatcactgaagctgggtgactttggactggccaccattgtagacggccccctgtacacagtctgtggcaccccaacatacgtggctccagaaatcattgcagagactggatacggcctcaaggtggacatctgggcagcaggtgtaatcacttatatcctgctgtgtggtttccctccattccgtggaagtggtgatgaccaggaggtgctttttgatcagattttgatggggcaggtggactttccttctccatactgggataatgtttccgattctgcaaaggagctcattaccatgatgctgttggtcgatgtagatcagcgattttctgctgttcaagtacttgagcatccctgggttaatgatgatggcctcccagaaaatgaacatcagctgtcagtagctggaaagataaagaagcatttcaacacaggccccaagccgaatagcacagcagctggagtttctgtcatagcaaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttcgacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacaattccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctagtgcagtgtctccaggcctgagtttcttctggaacagattccattttagaatggggattcacaggttctgtgcatcaccacagtgctcagagaggattctcctggggtgtcttagaggcaggtgcccaactcaaatgtattcccaaggtttgctgggctctgggatccacgagacaaccagagagggatatctcatgaaatttgcatctggtggctgaacagtacctatgttctctgttttgaatatactttaatacctgagagtcttaaaatttgtgaacaacgtttctatagtcctttattttcaaatgcacattgatcttcacttgctgcatttttactcttcaaccctgaaactatggtctacattaatatggatttttaaatcacatgtcattacttttgcaacaccatcaccaaaattttttgctcttttacatttaggttcatctctgtggtctgtgttgtcctgacatgtaaaaagcatatcgtttattgaggtttttttcccccccttttagagcatccggaagtgataacacgcaaaatcacaaagtagcataaatcagtaaattagttgagttgtttttgggggggaggtgggggtagggggcacagaacaccagaaagagtgttggtgtgtaggtagattccatattaatgaggaacactgaactagttggaaattactgctttctctagaaatataaagcaaagcactattccaaggctatggagtagctctacagcctggcctcaactctaaaagtgtgaagaatgcaatgggcagagacctacctgcagtggactgtcattttcctttctttctctgaattactgctttttctgtgggcattaactatattgctacagcatctagtgtactgagcctgcggtgcatggctcaggccttttcccatcgacgtctagggggactctggaccgtgtgaagctagggggtgtttctcagcacactgcagaagggcagctcagaagaatgcagggcccattcagcatggggatcccagcacatcactgtagaatttgagtgatctatgctgaataaacagtggaatgtgaccagtcaagtagaaatcttgagtaatcagatggaatgcaatctttctaacattaagctaccaagatcctgaatgtcagagatgtactcagagggttaacagacaagcacaaggcatgctgactacattggtgtatccagattgctttgcttttagccagtgctttctaatttttttctcgacattcttgggatagttcaagtttgaaataattaagtggtggtgttctttaaggaatttctataaccaaattgatcttatttttgatttcacttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactgacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaacacttggtgttttgtgttcaatgagaccttcctgcaacctgctccccatgggtggcagttaacaggcccatcagatattgttgaaagaaagcaatatatccatgaatgaaggctaaaattgcaatcctttaccctttgaggcatatttcagttgaaaacaaaaagaaaagaaaatttggcttagagggtcacagagctcccatatgaccaagtctcaagcacattaaatcatggttgtttactggccaagggcgtccactagacaactctatcccttgcgctgaagctcaatcgtgctgagggagagctttcttaatattactgtgttgctcttagcccttctctgggttaggatctgtcagcatttctatgataaactcctattctcaaaggtttttaatttgaccataaaaatgtgccccaggctgaagtttgctatacagggctgtaccaaagagtgaaggtttacttccttctctttccaacttcttccccattctccaaggaaaagaacaacaaaaaaatctggtatggtccctccttaatagtgatttcagaattttggaaagcaccaagatccaagatggtagttttaatgtagttactcattcgcacacattttttaaatttaatgggtcacctggcatatattgtagataacatatcttttctataatttgtaagtcaataatttttttaactgctacatgatatttttttttgcccaaagattttaaaagacttgaagttggtcagttcaaaactcagatttttctacacattgtctgccatgtccattaggagtttggggaaaatactctcacacagacccttactttgcatgcagtttagagggtaagatacgtgcttcttttggggataaagatttccttacttaattgtcaaatttcatggagccattctagtctgttggggaaaatagtgattaaaagcacttccaaaattaacattttttgacaattcagatatgaaaagaagcaggggaaaataatacactttactcttttcttgcttaaaggcaaacaaatcaatgaaacttgaggacacactaaacatttgataactgcaaatgtgctttaaaaattggttcaatggtgcttacacatgaaacggtaacaaatggggttcctaggacgtcagaaggaatctttagtttgtatgtaattacacactagaggaggaggtgcttttaagccagtcttttatttttaatcatctcaaatatgcaaccatacatgcagtaacattaagggtcgtaaactggtgggaaacaggaacttcagtggagaggcttaaatgcctctggttagagtgggggtttttgtttgtttgtttattgttgggtttcaacactgagcatcatttctgtgatcaagtttctaactggcatgtgttttgatcatgaggtttaccatatcttgcccatacagacaaatgagagatctagtttcattttgttccctaaagaaagaacactctctaaaattaaatcatacctgtaaatttcttcagcatttgtttctgttcaatgaaattgagacccttaatgttgctttaatgtaaaattgaatattttgtctgtgatatactttaataatttaaagtaagtaatagttctaaagtcttcactgttgctactaagagaaaatagaattttaaaggtgatgataaagatgctataatgtcagttcactccagtccaatcaaatgtagtaagaaaaagtccttgaatagttctctagggacaatttctcacttgccattgacattaatctttggtgtattctcagaaaaaataaaaagaaattgaaactggtccaaggttatagtcatatcctcgataacttttgaaaaaaaattttattaggaaattaatactagcctttttcattctggctgaaagaaaattattaaaggattagttgagtgtgaaattcaacagtattttgctcatacatactaaaaaggtgcgtagggacttggcgcatttaaacaagtttctgaaaggtttcaatttgactcaagaaaaaaattcaatatttcttttgaaaatactgaatttatcacttgctgcatggatcagatggcataggttaatctttgattttcagaatcctaatgaaataactttcaaacaatttgtgtccttaattaaaggtggaatgagatccaatttttccccctaatccttcagtttaagctgatacatgtaggttaatgtggaatgaaatcatctgtgatatattatgttcatttatcaactgagcttttttgatgttgcctgtttttatgtaaaacatgttcttaaagttaataaaataatagtacttggtgtatgaactactacataatacctta

SEQ ID NO: 127980 - DNA, 2101 bp, Homo sapiens
  Payload ID: 5060
  Gene Symbol: DCLK1
  Gene Name: doublecortin-like kinase 1
  ENST ID: ENST00000379892
  CDS Start-End: 213-1304
gcacatccctgcactagtggccgcaaccgaggcgccgcgctccagcagctgctgccgcccagcccggccccgccgccgccccccagccctgcagccccgcagccccggccgcgcccagcccggcgaggacagcaccaggaggcggcccccagcgcggccacaaagacccccggcggcgtctctccgcggaccggtcctacttgaagtccatcatgtccttcggcagagacatggagctggagcacttcgacgagcgggataaggcgcagagatacagccgagggtcgcgggtgaacggcctgccgagcccgacgcacagcgcccactgcagcttctaccgcacccgcacgctgcagacgctcagctccgagaagaaggccaagaaagttcgtttctatcgaaacggagatcgatacttcaaagggattgtgtatgccatctccccagaccggttccgatcttttgaggccctgctggctgatttgacccgaactctgtcggataacgtgaatttgccccagggagtgagaacaatctacaccattgatgggctcaagaagatttccagcctggaccaactggtggaaggagagagttatgtatgtggctccatagagcccttcaagaaactggagtacaccaagaatgtgaaccccaactggtcggtgaacgtcaagaccacctcggcttctcgggcagtgtcttcactggccactgccaaaggaagcccttcagaggtgcgagagaataaggatttcattcggcccaagctggtcaccatcatcagaagtggcgtgaagccacggaaagctgtcaggattctgctgaacaagaaaacggctcattcctttgagcaggtcctcaccgatatcaccgatgccatcaagctggactcgggagtggtgaaacgcctgtacacgttggatgggaaacaggtgatgtgccttcaggacttttttggtgatgatgacatttttattgcatgtggaccggagaagttccgttaccaggatgatttcttgctagatgaaagtgaatgtcgagtggtaaagtccacttcttacaccaaaatagcttcatcatcccgcaggagcaccaccaagagcccaggaccgtccaggcgtagcaagtcccctgcctccaccagctcagttaatggaacccctggtagtcagctctctactccgcgctcaggcaagtcgccaagcccatcacccaccagcccaggaagcctgcggaagcagagggacctgtaccgccccctctcttcggatgacttggattcagtaggagactcagtgtaaaagaaacaatggagcaatgtatatggtttgtgattgggtgaaggtttcacatttctgaagcaaaagtcttacagcaaaatacacaaaagagttttgcataccttgaaatgataaaagaccaaatcatccaaaagtaaatatgtatgcattttgttttcgtgatgttcaaccttgaaattgagagatttttaaaaatatctcccacatggatttgattggggagagtttgaacacaaaatgctgagatttttgtacagggcctggctctagatgaatttcatacacggacccaatattgagtacaagaacacactaaccatgtggcaatatagagccagaatttctgcagatggagttttcttcttaattataagtagacatagagatataatttttctgtactttctgtaaagcatattaaaacggcactagcaggcatattttttctaaaggttatattgtttttaaaatttgaattgcttggtttttagaggtacttttattacaaaataataaaaatacttgggtagattttttttctccctagacagtagaaaaagctacttactgttttgtgggttagtacatccgagagaaaaagaaaaattatgacaacgacacatctcataaagactctgaagttaggctttaggaacttgccttgtttttgttgtcaagtaaattttattttttaaagttattttattagaaacagtataaatttagcttaagctatatgccaatatgaagaacttggccaatggcattgctatagattgtataattttttcttacaa

SEQ ID NO: 127981 - DNA, 4612 bp, Homo sapiens
  Payload ID: 5060
  Gene Symbol: DCLK1
  Gene Name: doublecortin-like kinase 1
  Uniprot ID: O15075
  ENST ID: ENST00000379893
  CDS Start-End: 115-1416
agccttagccatccttaaactcatccaaccgattcccatttccgcgggtgcttggcttagtgctgagacgggattccgccgttggtattcaggtccaacactaagactgtgtccatgttagaactcatagaagttaatggaacccctggtagtcagctctctactccgcgctcaggcaagtcgccaagcccatcacccaccagcccaggaagcctgcggaagcagaggagctctcagcatggcggctcctctacgtcacttgcgtccaccaaagtctgcagctcgatggatgagaacgatggccctggagaagaagtgtcggaggaaggcttccagattccagctacaataacagaacgatataaagtcggaagaacaataggagatggaaattttgctgttgtcaaggaatgtgtagaaagatcgactgctagagagtatgctctgaaaattatcaagaaaagcaaatgtcgaggcaaagagcacatgatccagaatgaagtgtctattttaagaagagtgaagcatcccaatatcgttcttctgattgaggagatggatgtgccaactgaactgtatcttgtcatggaattagtaaaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtgtatgagcaccaagatggcagcaaatcactgaagctgggtgactttggactggccaccattgtagacggccccctgtacacagtctgtggcaccccaacatacgtggctccagaaatcattgcagagactggatacggcctcaaggtggacatctgggcagcaggtgtaatcacttatatcctgctgtgtggtttccctccattccgtggaagtggtgatgaccaggaggtgctttttgatcagattttgatggggcaggtggactttccttctccatactgggataatgtttccgattctgcaaaggagctcattaccatgatgctgttggtcgatgtagatcagcgattttctgctgttcaagtacttgagcatccctgggttaatgatgatggcctcccagaaaatgaacatcagctgtcagtagctggaaagataaagaagcatttcaacacaggccccaagccgaatagcacagcagctggagtttctgtcatagcaaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttcgacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacaattccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctagtgcagtgtctccaggcctgagtttcttctggaacagattccattttagaatggggattcacaggttctgtgcatcaccacagtgctcagagaggattctcctggggtgtcttagaggcaggtgcccaactcaaatgtattcccaaggtttgctgggctctgggatccacgagacaaccagagagggatatctcatgaaatttgcatctggtggctgaacagtacctatgttctctgttttgaatatactttaatacctgagagtcttaaaatttgtgaacaacgtttctatagtcctttattttcaaatgcacattgatcttcacttgctgcatttttactcttcaaccctgaaactatggtctacattaatatggatttttaaatcacatgtcattacttttgcaacaccatcaccaaaattttttgctcttttacatttaggttcatctctgtggtctgtgttgtcctgacatgtaaaaagcatatcgtttattgaggtttttttcccccccttttagagcatccggaagtgataacacgcaaaatcacaaagtagcataaatcagtaaattagttgagttgtttttgggggggaggtgggggtagggggcacagaacaccagaaagagtgttggtgtgtaggtagattccatattaatgaggaacactgaactagttggaaattactgctttctctagaaatataaagcaaagcactattccaaggctatggagtagctctacagcctggcctcaactctaaaagtgtgaagaatgcaatgggcagagacctacctgcagtggactgtcattttcctttctttctctgaattactgctttttctgtgggcattaactatattgctacagcatctagtgtactgagcctgcggtgcatggctcaggccttttcccatcgacgtctagggggactctggaccgtgtgaagctagggggtgtttctcagcacactgcagaagggcagctcagaagaatgcagggcccattcagcatggggatcccagcacatcactgtagaatttgagtgatctatgctgaataaacagtggaatgtgaccagtcaagtagaaatcttgagtaatcagatggaatgcaatctttctaacattaagctaccaagatcctgaatgtcagagatgtactcagagggttaacagacaagcacaaggcatgctgactacattggtgtatccagattgctttgcttttagccagtgctttctaatttttttctcgacattcttgggatagttcaagtttgaaataattaagtggtggtgttctttaaggaatttctataaccaaattgatcttatttttgatttcacttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactgacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaacac

SEQ ID NO: 127982 - DNA, 7592 bp, Homo sapiens
  Payload ID: 5060
  Gene Symbol: DCLK1
  Gene Name: doublecortin-like kinase 1
  Uniprot ID: O15075
  ENST ID: ENST00000615680
  CDS Start-End: 334-1602
acttcattatgattcagtgcaaagtactgacagcactggggcttccggaagggagtggtgtcgggatgggggttgctgttggcaagaggcttaattgacacctttgatgtagcctaagacagaacctgcacctcccactgctgcttgggagacgtcagctttacgcagaaaaggcatctgctgatgaatcctgcatctcattcagcctgctctgggagcagccttagccatccttaaactcatccaaccgattcccatttccgcgggtgcttggcttagtgctgagacgggattccgccgttggtattcaggtccaacactaagactgtgtccatgttagaactcatagaagttaatggaacccctggtagtcagctctctactccgcgctcaggcaagtcgccaagcccatcacccaccagcccaggaagcctgcggaagcagaggagctctcagcatggcggctcctctacgtcacttgcgtccaccaaagtctgcagctcgatggatgagaacgatggccctggagaagaagtgtcggaggaaggcttccagattccagctacaataacagaacgatataaagtcggaagaacaataggagatggaaattttgctgttgtcaaggaatgtgtagaaagatcgactgctagagagtatgctctgaaaattatcaagaaaagcaaatgtcgaggcaaagagcacatgatccagaatgaagtgtctattttaagaagagtgaagcatcccaatatcgttcttctgattgaggagatggatgtgccaactgaactgtatcttgtcatggaattagtaaaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtgtatgagcaccaagatggcagcaaatcactgaagctgggtgactttggactggccaccattgtagacggccccctgtacacagtctgtggcaccccaacatacgtggctccagaaatcattgcagagactggatacggcctcaaggtggacatctgggcagcaggtgtaatcacttatatcctgctgtgtggtttccctccattccgtggaagtggtgatgaccaggaggtgctttttgatcagattttgatggggcaggtggactttccttctccatactgggataatgtttccgattctgcaaaggagctcattaccatgatgctgttggtcgatgtagatcagcgattttctgctgttcaagtacttgagcatccctgggttaatgatgatggcctcccagaaaatgaacatcagctgtcagtagctggaaagataaagaagcatttcaacacaggccccaagccgaatagcacagcagctggagtttctgtcatagcactggaccacgggtttaccatcaagagatcagggtctttggactactaccagcaaccaggaatgtattggataagaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttcgacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacaattccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctagtgcagtgtctccaggcctgagtttcttctggaacagattccattttagaatggggattcacaggttctgtgcatcaccacagtgctcagagaggattctcctggggtgtcttagaggcaggtgcccaactcaaatgtattcccaaggtttgctgggctctgggatccacgagacaaccagagagggatatctcatgaaatttgcatctggtggctgaacagtacctatgttctctgttttgaatatactttaatacctgagagtcttaaaatttgtgaacaacgtttctatagtcctttattttcaaatgcacattgatcttcacttgctgcatttttactcttcaaccctgaaactatggtctacattaatatggatttttaaatcacatgtcattacttttgcaacaccatcaccaaaattttttgctcttttacatttaggttcatctctgtggtctgtgttgtcctgacatgtaaaaagcatatcgtttattgaggtttttttcccccccttttagagcatccggaagtgataacacgcaaaatcacaaagtagcataaatcagtaaattagttgagttgtttttgggggggaggtgggggtagggggcacagaacaccagaaagagtgttggtgtgtaggtagattccatattaatgaggaacactgaactagttggaaattactgctttctctagaaatataaagcaaagcactattccaaggctatggagtagctctacagcctggcctcaactctaaaagtgtgaagaatgcaatgggcagagacctacctgcagtggactgtcattttcctttctttctctgaattactgctttttctgtgggcattaactatattgctacagcatctagtgtactgagcctgcggtgcatggctcaggccttttcccatcgacgtctagggggactctggaccgtgtgaagctagggggtgtttctcagcacactgcagaagggcagctcagaagaatgcagggcccattcagcatggggatcccagcacatcactgtagaatttgagtgatctatgctgaataaacagtggaatgtgaccagtcaagtagaaatcttgagtaatcagatggaatgcaatctttctaacattaagctaccaagatcctgaatgtcagagatgtactcagagggttaacagacaagcacaaggcatgctgactacattggtgtatccagattgctttgcttttagccagtgctttctaatttttttctcgacattcttgggatagttcaagtttgaaataattaagtggtggtgttctttaaggaatttctataaccaaattgatcttatttttgatttcacttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactgacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaacacttggtgttttgtgttcaatgagaccttcctgcaacctgctccccatgggtggcagttaacaggcccatcagatattgttgaaagaaagcaatatatccatgaatgaaggctaaaattgcaatcctttaccctttgaggcatatttcagttgaaaacaaaaagaaaagaaaatttggcttagagggtcacagagctcccatatgaccaagtctcaagcacattaaatcatggttgtttactggccaagggcgtccactagacaactctatcccttgcgctgaagctcaatcgtgctgagggagagctttcttaatattactgtgttgctcttagcccttctctgggttaggatctgtcagcatttctatgataaactcctattctcaaaggtttttaatttgaccataaaaatgtgccccaggctgaagtttgctatacagggctgtaccaaagagtgaaggtttacttccttctctttccaacttcttccccattctccaaggaaaagaacaacaaaaaaatctggtatggtccctccttaatagtgatttcagaattttggaaagcaccaagatccaagatggtagttttaatgtagttactcattcgcacacattttttaaatttaatgggtcacctggcatatattgtagataacatatcttttctataatttgtaagtcaataatttttttaactgctacatgatatttttttttgcccaaagattttaaaagacttgaagttggtcagttcaaaactcagatttttctacacattgtctgccatgtccattaggagtttggggaaaatactctcacacagacccttactttgcatgcagtttagagggtaagatacgtgcttcttttggggataaagatttccttacttaattgtcaaatttcatggagccattctagtctgttggggaaaatagtgattaaaagcacttccaaaattaacattttttgacaattcagatatgaaaagaagcaggggaaaataatacactttactcttttcttgcttaaaggcaaacaaatcaatgaaacttgaggacacactaaacatttgataactgcaaatgtgctttaaaaattggttcaatggtgcttacacatgaaacggtaacaaatggggttcctaggacgtcagaaggaatctttagtttgtatgtaattacacactagaggaggaggtgcttttaagccagtcttttatttttaatcatctcaaatatgcaaccatacatgcagtaacattaagggtcgtaaactggtgggaaacaggaacttcagtggagaggcttaaatgcctctggttagagtgggggtttttgtttgtttgtttattgttgggtttcaacactgagcatcatttctgtgatcaagtttctaactggcatgtgttttgatcatgaggtttaccatatcttgcccatacagacaaatgagagatctagtttcattttgttccctaaagaaagaacactctctaaaattaaatcatacctgtaaatttcttcagcatttgtttctgttcaatgaaattgagacccttaatgttgctttaatgtaaaattgaatattttgtctgtgatatactttaataatttaaagtaagtaatagttctaaagtcttcactgttgctactaagagaaaatagaattttaaaggtgatgataaagatgctataatgtcagttcactccagtccaatcaaatgtagtaagaaaaagtccttgaatagttctctagggacaatttctcacttgccattgacattaatctttggtgtattctcagaaaaaataaaaagaaattgaaactggtccaaggttatagtcatatcctcgataacttttgaaaaaaaattttattaggaaattaatactagcctttttcattctggctgaaagaaaattattaaaggattagttgagtgtgaaattcaacagtattttgctcatacatactaaaaaggtgcgtagggacttggcgcatttaaacaagtttctgaaaggtttcaatttgactcaagaaaaaaattcaatatttcttttgaaaatactgaatttatcacttgctgcatggatcagatggcataggttaatctttgattttcagaatcctaatgaaataactttcaaacaatttgtgtccttaattaaaggtggaatgagatccaatttttccccctaatccttcagtttaagctgatacatgtaggttaatgtggaatgaaatcatctgtgatatattatgttcatttatcaactgagcttttttgatgttgcctgtttttatgtaaaacatgttcttaaagttaataaaataatagtacttggtgtatgaactactacataataccttagctgaagggtacgctcctcagttcatttgccatattggagtaaaatttcaccttagttcaattcacaattgacacattcagttcacgaaggaatagcccagctgtgttcttagggggaattctctctatgcaaggctttaaaaattagtcatgcggtcagagtgtagctttcccacatgtcctccatagcacagtgtgtatttcatgagcataattcaaaaacagctatttcaaaaatgtcccttgtcatatattacgttcctgcctgggccactgacttggataaatacaaataaaccaaataccattca

SEQ ID NO: 127983 - DNA, 4265 bp, Homo sapiens
  Payload ID: 5061
  Gene Symbol: DCLK2
  Gene Name: doublecortin-like kinase 2
  Uniprot ID: Q8N568
  ENST ID: ENST00000296550
  CDS Start-End: 755-3055
ccgcggtttggcatccccggggccgggaagcctcctccagcgctgacagcctgtcggcggcggagggaggccagagcgcggatgcttgccagtgggccgggcctgaccgctgcgtgggaggcgggctgcattatttcccgctagggccgcgctccagggaaggaaggggccagacacggccctctcagccccgaacggcgcgcgctgcccggcgggcgggatccgggcgcggccgaggcggcggcgctgcaccccgggcctgggcccgcgcgactcccccgggggcctctcccacgctccgcgccccgccccacccttccttccttcctcccctcggcgctcccgggagcgctcggcagacgcccgagctttgtgggcgcccgcgggcccagcgcgagcctcgggcggcccaactttgcctctcccggtcggctcccgagcgggacttgtgaggcgtggccgggtggaggaggcgcttgcgggggcgtggggctccccggcaggcgggaggcacggagcaagtcgcactggacaatgacctgggcagctcggcgctgcggacacttttagctgagggcgcgggcgggtcggctcctccgcggctcctcggccccacctgcgcggagagggcgggatgccagagccaggtgtcccggcgcgttaagggccctcgcagtcagacgtccctgcaccggcgctcgcacccttagtcggcccggaacgtctttttgcggacgccctcggagcagccgcgatggccagcaccaggagtatcgagctggagcactttgaggaacgggacaaaaggccgcggccggggtcgcggagaggggcccccagctcctccgggggcagcagcagctcgggccccaaggggaacgggctcatccccagtccggcgcacagtgcccactgcagcttctaccgcacgcggaccctgcaggccctcagctcggagaagaaggccaagaaggcgcgcttctaccggaacggggaccgctacttcaagggcctggtgtttgccatctccagcgaccgcttccggtccttcgatgcgctcctcatagagctcacccgctccctgtcggacaacgtgaacctgccccagggtgtccgcactatctacaccatcgacggcagccggaaggtcaccagcctggacgagctgctggaaggtgagagttacgtgtgtgcatccaatgaaccatttcgtaaagtcgattacaccaaaaatattaatccaaactggtctgtgaacatcaagggtgggacatcccgagcgctggctgctgcctcctctgtgaaaagtgaagtaaaagaaagtaaagatttcatcaaacccaagttagtgactgtgattcgaagtggagtgaagcctagaaaagccgtgcggatccttctgaataaaaagactgctcattcctttgaacaagtcttaacagatatcaccgaagccattaaactagactcaggagtcgtcaagaggctctgcaccctggatggaaagcaggttacttgtctgcaagacttttttggtgatgacgatgtttttattgcatgtggaccagaaaaatttcgttatgcccaagatgactttgtcctggatcatagtgaatgtcgtgtcctgaagtcatcttattctcgatcctcagctgttaagtattctggatccaaaagccctgggccctctcgacgcagcaaatcaccagcttcagttaatggaactcccagcagccaactttctactcctaaatctacgaaatcctccagttcctctccaactagtccaggaagtttcagaggattaaagcagatttctgctcatggcagatcttcttccaatgtaaacggtggacctgagcttgaccgttgcataagtcctgaaggtgtgaatggaaacagatgctctgaatcatcaactcttcttgagaaatacaaaattggaaaggtcattggtgatggcaattttgcagtagtcaaagagtgtatagacaggtccactggaaaggagtttgccctaaagattatagacaaagccaaatgttgtggaaaggaacacctgattgagaatgaagtgtcaatactgcgccgagtgaaacatcccaatatcattatgctggtcgaggagatggaaacagcaactgagctctttctggtgatggaattggtcaaaggtggagatctctttgatgcaattacttcgtcgaccaagtacactgagagagatggcagtgccatggtgtacaacttagccaatgccctcaggtatctccatggcctcagcatcgtgcacagagacatcaaaccagagaatctcttggtgtgtgaatatcctgatggaaccaagtctttgaaactgggagactttgggcttgcgactgtggtagaaggccctttatacacagtctgtggcacacccacttatgtggctccagaaatcattgctgaaactggctatggcctgaaggtggacatttgggcagctggtgtgatcacatacatacttctctgtggattcccaccattccgaagtgagaacaatctccaggaagatctcttcgaccagatcttggctgggaagctggagtttccggccccctactgggataacatcacggactctgccaaggaattaatcagtcaaatgcttcaggtaaatgttgaagctcggtgtaccgcgggacaaatcctgagtcacccctgggtgtcagatgatgcctcccaggagaataacatgcaagctgaggtgacaggtaaactaaaacagcactttaataatgcgctccccaaacagaacagcactaccaccggggtctccgtcatcatgaacacggctctagataaggaggggcagattttctgcagcaagcactgtcaagacagcggcaggcctgggatggagcccatctctccagttcctccctcagtggaggagatccctgtgcctggggaagcagtcccggcccccacccctccggaatctcccaccccccaccctcctcccgctgccccgggtggtgagcgggcaggaacctggcgccgccaccgagactgagcctcctgcagacgggcgaagccgcctgctgcagcccaggaagccagccctctgctcggcctcgccggcctccctgctgcaggcctccctctcttcaccgcctgcgcctgagttcgcgggtcctccgcaggccgcctgggaaccggagcctggcgtgccggagcctggcctggtgctctgggctctgccttctggttcctggaggcatcaaaggctgcatccgttctgccaacagctgttcggagagactcgttccagatcatcccgtcattttcagtttgttggacattttacagcttcaccaggagaatgtgcaactttattccagcattcgatgcatttttatagaaacactttggaaacactttggatgaaccaaggccttttccttatttaagtagactcagaacactccctttcttttcttttctctctctctctctcttttttttttacgaaagacttagaattgcatttgtccttttgtgggtgtcctgtgagaggtgatatgggggctaagaggactggctttctaatagaagaagtgagcgcctgagaggacaatttggtcattggacacggattgcaggctttgagaagcgctcagaggcccagggcggcgggctcagccattcggcttggggcaccaggctccccagagacaatgctcagtattcattcatacacagacgatggaagaagccacttcttccctgggcggtgtgggtttcccccagctcttcccacacgtgtgttaggaaatgcccgtgaacttgccctctgggctttttaatgagaggcttggcgcatgcggcacccagcggctgcttccctgcaagccagcgacttgccgagcagaatgagctctgctcctgagccccggtagctgcttcctcatctgcatttcatctggagcagggcaggtaaccacaggaggaggcatgcccgaggcagccaggactgggcgggaaggtgctccctggatatactctgtgaaccttctggaaggctgctggcagtttttcctttttgtccaccaccctgctctttttaataattgtacataatccgtgtatttgttttacctgctcatcttctaaactggcgagccctatagttcgttctcattgttagattttgccttttacaagtgtccccaacctgcaataaacttttccctcttgaaaaaaagtaatcagggatgggcaaa

SEQ ID NO: 127984 - DNA, 3543 bp, Homo sapiens
  Payload ID: 5061
  Gene Symbol: DCLK2
  Gene Name: doublecortin-like kinase 2
  Uniprot ID: Q8N568
  ENST ID: ENST00000302176
  CDS Start-End: 1-2352
atggccagcaccaggagtatcgagctggagcactttgaggaacgggacaaaaggccgcggccggggtcgcggagaggggcccccagctcctccgggggcagcagcagctcgggccccaaggggaacgggctcatccccagtccggcgcacagtgcccactgcagcttctaccgcacgcggaccctgcaggccctcagctcggagaagaaggccaagaaggcgcgcttctaccggaacggggaccgctacttcaagggcctggtgtttgccatctccagcgaccgcttccggtccttcgatgcgctcctcatagagctcacccgctccctgtcggacaacgtgaacctgccccagggtgtccgcactatctacaccatcgacggcagccggaaggtcaccagcctggacgagctgctggaaggtgagagttacgtgtgtgcatccaatgaaccatttcgtaaagtcgattacaccaaaaatattaatccaaactggtctgtgaacatcaagggtgggacatcccgagcgctggctgctgcctcctctgtgaaaagtgaagtaaaagaaagtaaagatttcatcaaacccaagttagtgactgtgattcgaagtggagtgaagcctagaaaagccgtgcggatccttctgaataaaaagactgctcattcctttgaacaagtcttaacagatatcaccgaagccattaaactagactcaggagtcgtcaagaggctctgcaccctggatggaaagcaggttacttgtctgcaagacttttttggtgatgacgatgtttttattgcatgtggaccagaaaaatttcgttatgcccaagatgactttgtcctggatcatagtgaatgtcgtgtcctgaagtcatcttattctcgatcctcagctgttaagtattctggatccaaaagccctgggccctctcgacgcagcaaatcaccagcttcagtaaagcggggtggccactactccagtgcctattctacagccaaatccccagttaatggaactcccagcagccaactttctactcctaaatctacgaaatcctccagttcctctccaactagtccaggaagtttcagaggattaaagcagatttctgctcatggcagatcttcttccaatgtaaacggtggacctgagcttgaccgttgcataagtcctgaaggtgtgaatggaaacagatgctctgaatcatcaactcttcttgagaaatacaaaattggaaaggtcattggtgatggcaattttgcagtagtcaaagagtgtatagacaggtccactggaaaggagtttgccctaaagattatagacaaagccaaatgttgtggaaaggaacacctgattgagaatgaagtgtcaatactgcgccgagtgaaacatcccaatatcattatgctggtcgaggagatggaaacagcaactgagctctttctggtgatggaattggtcaaaggtggagatctctttgatgcaattacttcgtcgaccaagtacactgagagagatggcagtgccatggtgtacaacttagccaatgccctcaggtatctccatggcctcagcatcgtgcacagagacatcaaaccagagaatctcttggtgtgtgaatatcctgatggaaccaagtctttgaaactgggagactttgggcttgcgactgtggtagaaggccctttatacacagtctgtggcacacccacttatgtggctccagaaatcattgctgaaactggctatggcctgaaggtggacatttgggcagctggtgtgatcacatacatacttctctgtggattcccaccattccgaagtgagaacaatctccaggaagatctcttcgaccagatcttggctgggaagctggagtttccggccccctactgggataacatcacggactctgccaaggaattaatcagtcaaatgcttcaggtaaatgttgaagctcggtgtaccgcgggacaaatcctgagtcacccctgggtgtcagatgatgcctcccaggagaataacatgcaagctgaggtgacaggtaaactaaaacagcactttaataatgcgctccccaaacagaacagcactaccaccggggtctccgtcatcatgaacacggctctagataaggaggggcagattttctgcagcaagcactgtcaagacagcggcaggcctgggatggagcccatctctccagttcctccctcagtggaggagatccctgtgcctggggaagcagtcccggcccccacccctccggaatctcccaccccccaccctcctcccgctgccccgggtggtgagcgggcaggaacctggcgccgccaccgagactgagcctcctgcagacgggcgaagccgcctgctgcagcccaggaagccagccctctgctcggcctcgccggcctccctgctgcaggcctccctctcttcaccgcctgcgcctgagttcgcgggtcctccgcaggccgcctgggaaccggagcctggcgtgccggagcctggcctggtgctctgggctctgccttctggttcctggaggcatcaaaggctgcatccgttctgccaacagctgttcggagagactcgttccagatcatcccgtcattttcagtttgttggacattttacagcttcaccaggagaatgtgcaactttattccagcattcgatgcatttttatagaaacactttggaaacactttggatgaaccaaggccttttccttatttaagtagactcagaacactccctttcttttcttttctctctctctctctcttttttttttacgaaagacttagaattgcatttgtccttttgtgggtgtcctgtgagaggtgatatgggggctaagaggactggctttctaatagaagaagtgagcgcctgagaggacaatttggtcattggacacggattgcaggctttgagaagcgctcagaggcccagggcggcgggctcagccattcggcttggggcaccaggctccccagagacaatgctcagtattcattcatacacagacgatggaagaagccacttcttccctgggcggtgtgggtttcccccagctcttcccacacgtgtgttaggaaatgcccgtgaacttgccctctgggctttttaatgagaggcttggcgcatgcggcacccagcggctgcttccctgcaagccagcgacttgccgagcagaatgagctctgctcctgagccccggtagctgcttcctcatctgcatttcatctggagcagggcaggtaaccacaggaggaggcatgcccgaggcagccaggactgggcgggaaggtgctccctggatatactctgtgaaccttctggaaggctgctggcagtttttcctttttgtccaccaccctgctctttttaataattgtacataatccgtgtatttgttttacctgctcatcttctaaactggcgagccctatagttcgttctcattgttagattttgccttttacaagtgtccccaacctgcaataaacttttccctcttgaaaaaaa

SEQ ID NO: 127985 - DNA, 3611 bp, Homo sapiens
  Payload ID: 5061
  Gene Symbol: DCLK2
  Gene Name: doublecortin-like kinase 2
  ENST ID: ENST00000411937
  CDS Start-End: 40-2127
ccggaacgtctttttgcggacgccctcggagcagccgcgatggccagcaccaggagtatcgagctggagcactttgaggaacgggacaaaaggccgcggccggggtcgcggagaggggcccccagctcctccgggggcagcagcagctcgggccccaaggggaacgggctcatccccagtccggcgcacagtgcccactgcagcttctaccgcacgcggaccctgcaggccctcagctcggagaagaaggccaagaaggcgcgcttctaccggaacggggaccgctacttcaagggcctggtgtttgccatctccagcgaccgcttccggtccttcgatgcgctcctcatagagctcacccgctccctgtcggacaacgtgaacctgccccagggtgtccgcactatctacaccatcgacggcagccggaaggtcaccagcctggacgagctgctggaaggtgagagttacgtgtgtgcatccaatgaaccatttcgtaaagtcgattacaccaaaaatattaatccaaactggtctgtgaacatcaagggtgggacatcccgagcgctggctgctgcctcctctgtgaaaagtgaagtaaaagaaagtaaagatttcatcaaacccaagttagtgactgtgattcgaagtggagtgaagcctagaaaagccgtgcggatccttctgaataaaaagactgctcattcctttgaacaagtcttaacagatatcaccgaagccattaaactagactcaggagtcgtcaagaggctctgcaccctggatggaaagcaggttacttgtctgcaagacttttttggtgatgacgatgtttttattgcatgtggaccagaaaaatttcgttatgcccaagatgactttgtcctggatcatagtgaatgtcgtgtcctgaagtcatcttattctcgatcctcagctgttaagtattctggatccaaaagccctgggccctctcgacgcagcaaatcaccagcttcagttaatggaactcccagcagccaactttctactcctaaatctacgaaatcctccagttcctctccaactagtccaggaagtttcagaggattaaagatttctgctcatggcagatcttcttccaatgtaaacggtggacctgagcttgaccgttgcataagtcctgaaggtgtgaatggaaacagatgctctgaatcatcaactcttcttgagaaatacaaaattggaaaggtcattggtgatggcaattttgcagtagtcaaagagtgtatagacaggtccactggaaaggagtttgccctaaagattatagacaaagccaaatgttgtggaaaggaacacctgattgagaatgaagtgtcaatactgcgccgagtgaaacatcccaatatcattatgctggtcgaggagatggaaacagcaactgagctctttctggtgatggaattggtcaaaggtggagatctctttgatgcaattacttcgtcgaccaagtacactgagagagatggcagtgccatggtgtacaacttagccaatgccctcaggtatctccatggcctcagcatcgtgcacagagacatcaaaccagagaatctcttggtgtgtgaatatcctgatggaaccaagtctttgaaactgggagactttgggcttgcgactgtggtagaaggccctttatacacagtctgtggcacacccacttatgtggctccagaaatcattgctgaaactggctatggcctgaaggtggacatttgggcagctggtgtgatcacatacatacttctctgtggattcccaccattccgaagtgagaacaatctccaggaagatctcttcgaccagatcttggctgggaagctggagtttccggccccctactgggataacatcacggactctgccaaggaattaatcagtcaaatgcttcaggtaaatgttgaagctcggtgtaccgcgggacaaatcctgagtcacccctgggtgtcagatgatgcctcccaggagaataacatgcaagctgaggtgacaggtaaactaaaacagcactttaataatgcgctccccaaacagaacagcactaccaccggggtctccgtcatcatgtttgatttgacagtttgagaggcacctcagagtttccttctttaccccgctgagacagtgggagagcctgaagcagaatcctgaacacggctctagataaggaggggcagattttctgcagcaagcactgtcaagacagcggcaggcctgggatggagcccatctctccagttcctccctcagtggaggagatccctgtgcctggggaagcagtcccggcccccacccctccggaatctcccaccccccaccctcctcccgctgccccgggtggtgagcgggcaggaacctggcgccgccaccgagactgagcctcctgcagacgggcgaagccgcctgctgcagcccaggaagccagccctctgctcggcctcgccggcctccctgctgcaggcctccctctcttcaccgcctgcgcctgagttcgcgggtcctccgcaggccgcctgggaaccggagcctggcgtgccggagcctggcctggtgctctgggctctgccttctggttcctggaggcatcaaaggctgcatccgttctgccaacagctgttcggagagactcgttccagatcatcccgtcattttcagtttgttggacattttacagcttcaccaggagaatgtgcaactttattccagcattcgatgcatttttatagaaacactttggaaacactttggatgaaccaaggccttttccttatttaagtagactcagaacactccctttcttttcttttctctctctctctctcttttttttttacgaaagacttagaattgcatttgtccttttgtgggtgtcctgtgagaggtgatatgggggctaagaggactggctttctaatagaagaagtgagcgcctgagaggacaatttggtcattggacacggattgcaggctttgagaagcgctcagaggcccagggcggcgggctcagccattcggcttggggcaccaggctccccagagacaatgctcagtattcattcatacacagacgatggaagaagccacttcttccctgggcggtgtgggtttcccccagctcttcccacacgtgtgttaggaaatgcccgtgaacttgccctctgggctttttaatgagaggcttggcgcatgcggcacccagcggctgcttccctgcaagccagcgacttgccgagcagaatgagctctgctcctgagccccggtagctgcttcctcatctgcatttcatctggagcagggcaggtaaccacaggaggaggcatgcccgaggcagccaggactgggcgggaaggtgctccctggatatactctgtgaaccttctggaaggctgctggcagtttttcctttttgtccaccaccctgctctttttaataattgtacataatccgtgtatttgttttacctgctcatcttctaaactggcgagccctatagttcgttctcattgttagattttgccttttacaagtgtccccaacctgcaataaacttttccctcttgaaaaaaa

SEQ ID NO: 127986 - DNA, 2298 bp, Homo sapiens
  Payload ID: 5061
  Gene Symbol: DCLK2
  Gene Name: doublecortin-like kinase 2
  Uniprot ID: Q8N568
  ENST ID: ENST00000506325
  CDS Start-End: 1-2298
atggccagcaccaggagtatcgagctggagcactttgaggaacgggacaaaaggccgcggccggggtcgcggagaggggcccccagctcctccgggggcagcagcagctcgggccccaaggggaacgggctcatccccagtccggcgcacagtgcccactgcagcttctaccgcacgcggaccctgcaggccctcagctcggagaagaaggccaagaaggcgcgcttctaccggaacggggaccgctacttcaagggcctggtgtttgccatctccagcgaccgcttccggtccttcgatgcgctcctcatagagctcacccgctccctgtcggacaacgtgaacctgccccagggtgtccgcactatctacaccatcgacggcagccggaaggtcaccagcctggacgagctgctggaaggtgagagttacgtgtgtgcatccaatgaaccatttcgtaaagtcgattacaccaaaaatattaatccaaactggtctgtgaacatcaagggtgggacatcccgagcgctggctgctgcctcctctgtgaaaagtgaagtaaaagaaagtaaagatttcatcaaacccaagttagtgactgtgattcgaagtggagtgaagcctagaaaagccgtgcggatccttctgaataaaaagactgctcattcctttgaacaagtcttaacagatatcaccgaagccattaaactagactcaggagtcgtcaagaggctctgcaccctggatggaaagcaggttacttgtctgcaagacttttttggtgatgacgatgtttttattgcatgtggaccagaaaaatttcgttatgcccaagatgactttgtcctggatcatagtgaatgtcgtgtcctgaagtcatcttattctcgatcctcagctgttaagtattctggatccaaaagccctgggccctctcgacgcagcaaatcaccagcttcagttaatggaactcccagcagccaactttctactcctaaatctacgaaatcctccagttcctctccaactagtccaggaagtttcagaggattaaagatttctgctcatggcagatcttcttccaatgtaaacggtggacctgagcttgaccgttgcataagtcctgaaggtgtgaatggaaacagatgctctgaatcatcaactcttcttgagaaatacaaaattggaaaggtcattggtgatggcaattttgcagtagtcaaagagtgtatagacaggtccactggaaaggagtttgccctaaagattatagacaaagccaaatgttgtggaaaggaacacctgattgagaatgaagtgtcaatactgcgccgagtgaaacatcccaatatcattatgctggtcgaggagatggaaacagcaactgagctctttctggtgatggaattggtcaaaggtggagatctctttgatgcaattacttcgtcgaccaagtacactgagagagatggcagtgccatggtgtacaacttagccaatgccctcaggtatctccatggcctcagcatcgtgcacagagacatcaaaccagagaatctcttggtgtgtgaatatcctgatggaaccaagtctttgaaactgggagactttgggcttgcgactgtggtagaaggccctttatacacagtctgtggcacacccacttatgtggctccagaaatcattgctgaaactggctatggcctgaaggtggacatttgggcagctggtgtgatcacatacatacttctctgtggattcccaccattccgaagtgagaacaatctccaggaagatctcttcgaccagatcttggctgggaagctggagtttccggccccctactgggataacatcacggactctgccaaggaattaatcagtcaaatgcttcaggtaaatgttgaagctcggtgtaccgcgggacaaatcctgagtcacccctgggtgtcagatgatgcctcccaggagaataacatgcaagctgaggtgacaggtaaactaaaacagcactttaataatgcgctccccaaacagaacagcactaccaccggggtctccgtcatcatgaacacggctctagataaggaggggcagattttctgcagcaagcactgtcaagacagcggcaggcctgggatggagcccatctctccagttcctccctcagtggaggagatccctgtgcctggggaagcagtcccggcccccacccctccggaatctcccaccccccaccctcctcccgctgccccgggtggtgagcgggcaggaacctggcgccgccaccgagactga

SEQ ID NO: 127987 - DNA, 2153 bp, Homo sapiens
  Payload ID: 5061
  Gene Symbol: DCLK2
  Gene Name: doublecortin-like kinase 2
  ENST ID: ENST00000635524
  CDS Start-End: 3-2153
cgatggccagcaccaggagtatcgagctggagcactttgaggaacgggacaaaaggccgcggccggggtcgcggagaggggcccccagctcctccgggggcagcagcagctcgggccccaaggggaacgggctcatccccagtccggcgcacagtgcccactgcagcttctaccgcacgcggaccctgcaggccctcagctcggagaagaaggccaagaaggcgcgcttctaccggaacggggaccgctacttcaagggcctggtgtttgccatctccagcgaccgcttccggtccttcgatgcgctcctcatagagctcacccgctccctgtcggacaacgtgaacctgccccagggtgtccgcactatctacaccatcgacggcagccggaaggtcaccagcctggacgagctgctggaaggtgagagttacgtgtgtgcatccaatgaaccatttcgtaaagtcgattacaccaaaaatattaatccaaactggtctgtgaacatcaagggtgggacatcccgagcgctggctgctgcctcctctgtgaaaagtgaagtaaaagaaagtaaagatttcatcaaacccaagttagtgactgtgattcgaagtggagtgaagcctagaaaagccgtgcggatccttctgaataaaaagactgctcattcctttgaacaagtcttaacagatatcaccgaagccattaaactagactcaggagtcgtcaagaggctctgcaccctggatggaaagcaggttacttgtctgcaagacttttttggtgatgacgatgtttttattgcatgtggaccagaaaaatttcgttatgcccaagatgactttgtcctggatcatagtgaatgtcgtgtcctgaagtcatcttattctcgatcctcagctgttaagtattctggatccaaaagccctgggccctctcgacgcagcaaatcaccagcttcagtaaagcggggtggccactactccagtgcctattctacagccaaatccccagttaatggaactcccagcagccaactttctactcctaaatctacgaaatcctccagttcctctccaactagtccaggaagtttcagaggattaaagatttctgctcatggcagatcttcttccaatgtaaacggtggacctgagcttgaccgttgcataagtcctgaaggtgtgaatggaaacagatgctctgaatcatcaactcttcttgagaaatacaaaattggaaaggtcattggtgatggcaattttgcagtagtcaaagagtgtatagacaggtccactggaaaggagtttgccctaaagattatagacaaagccaaatgttgtggaaaggaacacctgattgagaatgaagtgtcaatactgcgccgagtgaaacatcccaatatcattatgctggtcgaggagatggaaacagcaactgagctctttctggtgatggaattggtcaaaggtggagatctctttgatgcaattacttcgtcgaccaagtacactgagagagatggcagtgccatggtgtacaacttagccaatgccctcaggtatctccatggcctcagcatcgtgcacagagacatcaaaccagagaatctcttggtgtgtgaatatcctgatggaaccaagtctttgaaactgggagactttgggcttgcgactgtggtagaaggccctttatacacagtctgtggcacacccacttatgtggctccagaaatcattgctgaaactggctatggcctgaaggtggacatttgggcagctggtgtgatcacatacatacttctctgtggattcccaccattccgaagtgagaacaatctccaggaagatctcttcgaccagatcttggctgggaagctggagtttccggccccctactgggataacatcacggactctgccaaggaattaatcagtcaaatgcttcaggtaaatgttgaagctcggtgtaccgcgggacaaatcctgagtcacccctgggtgtcagatgatgcctcccaggagaataacatgcaagctgaggtgacaggtaaactaaaacagcactttaataatgcgctccccaaacagaacagcactaccaccggggtctccgtcatcatggtccaaggccatgaacacggctctagataa

SEQ ID NO: 127988 - DNA, 402 bp, Homo sapiens
  Payload ID: 5061
  Gene Symbol: DCLK2
  Gene Name: doublecortin-like kinase 2
  ENST ID: ENST00000634233
  CDS Start-End: 1-237
cgaagtgagaacaatctccaggaagatctcttcgaccagatcttggctgggaagctggagtttccggccccctactgggataacatcacggactctgccaaggatgatgcctcccaggagaataacatgcaagctgaggtgacaggtaaactaaaacagcactttaataatgcgctccccaaacagaacagcactaccaccggggtctccgtcatcatgtttgatttgacagtttgagaggcacctcagagtttccttctttaccccgctgagacagtgggagagcctgaagcagaatcctgaacacggctctagataaggaggggcagattttctgcagcaagcactgtcaagacagcggcaggcctgggatggagcccatctctccagttcctccctcag

SEQ ID NO: 127989 - DNA, 5344 bp, Homo sapiens
  Payload ID: 5062
  Gene Symbol: DCLK3
  Gene Name: doublecortin-like kinase 3
  Uniprot ID: Q9C098
  ENST ID: ENST00000416516
  CDS Start-End: 492-2438
gactcttgttggtgtttcatgggcagcaaaactggccctttttatctcagctgtagatccttgaaggacagcaaggcctatgtgaccattctctaaaatatttaagctcgagaatcacagagcggaagctgcaaggctcctggctgcctgccagccgagggaatctggagaaaccattcctggggccgcgtggccccgtcgtgcccttgttctgccctcggaatggccttcactcagcacatcctgagaacagccctctgaagcccagggtcgtgaccgtagtgaagctgggtgggcagcgcccccgaaagatcactctgctcctcaacaggcgatcagtgcagacgttcgagcagctcttagctgacatctcagaagccttgggctctcccagatggaagaatgaccgtgtgaggaaactgtttaacctcaagggcagggaaatcaggagcgtctctgatttcttcagggaaggggatgctttcatagctatgggcaaagaaccactgacactgaagagcattcaggtggctgtagaagaactgtaccccaacaaagcccgggccctgacactggcccagcacagccgtgccccttctccaaggctgaggagcaggctgtttagcaaggctctgaaaggagaccaccgctgtggggagaccgagacccccaagagctgcagcgaagttgcaggatgcaaggcagccatgaggcaccaggggaagatccccgaggagctttcactagatgacagagcgaggacccagaagaagtgggggagggggaaatgggagccagaacccagtagcaagccccccagggaagccactctggaagagaggcacgcaaggggagagaagcatcttggggtggagattgaaaagacctcgggtgaaattatcagatgcgagaagtgcaagagagagagggagctccagcagagcctggagcgtgagaggctttctctggggaccagtgagctggatatggggaagggcccaatgtatgatgtggagaagctggtgaggaccagaagctgcaggaggtctcccgaggcaaatcctgcaagtggggaggaagggtggaagggtgacagccacaggagcagccccaggaatcccactcaagagctgaggagacccagcaagagcatggacaagaaagaggacagaggcccagaggatcaagaaagccatgctcagggagcagccaaggccaagaaggaccttgtggaagttcttcctgtcacagaggaggggctgagggaggtgaagaaggacaccaggcccatgagcaggagcaaacatggtggctggctcctgagagagcaccaggcgggctttgagaagctccgcaggacccgaggagaagagaaggaggcagagaaggagaaaaagccatgtatgtctggaggcagaaggatgactctcagagatgaccaacctgcaaagctagaaaaggagcccaagacgaggccagaagagaacaagccagagcggcccagcggtcggaagccacggcccatgggcatcattgccgccaatgtggaaaagcattatgagactggccgggtcattggggatgggaactttgctgtcgtgaaggagtgcagacaccgcgagaccaggcaggcctatgcgatgaagatcattgacaagtccagactcaagggcaaggaggacatggtggacagtgagatcttgatcatccagagcctctctcaccccaacatcgtgaaattgcatgaagtctacgaaacagacatggaaatctacctgatcctggagtacgtgcagggaggagacctttttgacgccatcatagaaagtgtgaagttcccggagcccgatgctgccctcatgatcatggacttatgcaaagccctcgtccacatgcacgacaagagcattgtccaccgggacctcaagccggaaaaccttttggttcagcgaaatgaggacaaatctactaccttgaaattggctgattttggacttgcaaagcatgtggtgagacctatatttactgtgtgtgggaccccaacttacgtagctcccgaaattctttctgagaaaggttatggactggaggtggacatgtgggctgctggcgtgatcctctatatcctgctgtgtggctttcccccattccgcagccctgagagggaccaggacgagctctttaacatcatccagctgggccactttgagttcctccccccttactgggacaatatctctgatgctgctaaagatctggtgagccggttgctggtggtagaccccaaaaagcgctacacagctcatcaggttcttcagcacccctggatcgaaacagctggcaagaccaatacagtgaaacgacagaagcaggtgtcccccagcagcgagggtcacttccggagccagcacaagagggttgtggagcaggtatcatagtcaccaccttgggaatctgtccagcccccagttctgctcaaggacagagaaaaggatagaagtttgagagaaaaacaatgaaagaggcttcttcacataattggtgaatcagagggagagacactgagtatattttaaagcatattaaaaaaattaagtcaatgttaaatgtcacaacatatttttagatttgtatatttaaagcctttaatacatttttggggggtaagcattgtcatcagtgaggaattttggtaataatgatgtgttttgcttcccctttgtaaccaagtttattctgtactacaggagtggtgcttaccagggtctaaactccccctgtgagattaataaggtgcattgtggtctttctgtgttaataaaatgtgctctgaataacagaagtgggcctgtattctgattacttctttgtgctggtgatgacagcacaaaaattcaaaaatgaattatagttcaggcatatctcctgaagctgatatgactacatatagatgtgaaggacacttgattagttgacaagacctgtttatttaggatgcactaatcttggtctcttgcatttcagtcttaccaaaaatcagttttggtgcagtctgagacatggaaagaaaaaaaacaaaccattgaatcattcttgctcctgcaataccgttatactgcttttcagccccaattatccctgagcctgagtcatttctatgtgaagtcaggcgctcaggctgtgaccgtgttaacattttcagatcacgagggagccatttagtacattaatatgtcagaaatgcagtaaatggattacactggggctcgaaggagctcagagttcaagcacattcctacctgcagggcatacacccaggacacattccagatttctgtgctgaaatattggtctttgcagatgattctgggagtctgtgtgagctgacagcaagacatatcctaatatttcccaaattgaccttcctagattatgaatgacctggttagtaggccacaaaatctagtcaagagtgtggctttttcacgtctaccttccctaacagttttggagccatctgggcggaggcgtgtgttagttaggaaaaccggaatagtactagagaattcaacataaggaattgcttaatcaggttttggaaaatggaagaagcacaaaggaggctctggtataatttagagatagtaactgcaggaagtggctcctgttctttggagaaccaagggaagaagttggggttattagaacctattgaaggagaaatttcttgtagtggacactgtagtatgccactcaggtcctccaagactgaagggaataagctccttggggtgctgctggatgatggctctcagctttcagccctctacaggaattaccctccactggaagagacacctttcagctccctcctgaagcaggctatatcaaatgactagtccctgtagggtatggtggctcagctcctttgtcccaaacagggacaatactgaagggccatccaactacggacctgcccatgggggttggctgaactgttggttgagactgcatcatagcccactttctcccttgcccaatcctgcttctttcctttcccttccagaggtaatgatcctgagaccactccctaataagccttttggatgctaatctggattttagagttggcttctcgggaaaccaaaccgttgacaccccctagaaacttgaaaccacatcaaagaagtaccagctggtgctttaacctcagaagcttggagaaggggccctgtggagcagggactcagacccctgaggagtgggtgctgcccagcaggcagtgtaatgggactcattctgaacacgtgaaagaggctggaagctggattcagttgctactagaacatattttgataaagacaccagtaaccttcatttcactaaatccaaaagagaattttcaatcctcaaattagcatcacttgaccctattgaccactttctctttgaataatttctcctgttgactaccatgatgtcacatttttctggtttttttttctcctatacctttggatctcttgtatagattcagtcttcttccagttgctaaaagctgtagttgcatccttagtggctagggaaatgcaaattaaaatcacaatgaaatatcactatacacccattagaatagctaaaattaaatggctaaaatgagaagactgaccttaccaactactagcgaggatgcagagtgactggaacttcccgtacattgctgctgggagtataaaatgggacttctcctttggagaatggtttggtagttcctttaaaagttaaacatgtacctaccatatgatattccacttctagatgtttacccagcagaaattcaagcatatgtcctatgaagacttcacaatatttataggtgctttatttgtagtagccccaaagtggaaacatcttgaatgggcatgatttggtgcatggataaacagattgtatatccacacaatgaataacagccacaaaaaagggatgaactattcatacacgaacaacatggatggactgccaaagaattaggctgaatgaaagaagaaaaaaaagactacattttgattatttcatttacatactattccagaaaatacaagtgaatctatagtgacagaaagtgatcagggggtttgctggagatggaaatggggagaggagggacagaaggattgcaagggaacacttggtaactttggggaagagggacgtgttcattttcttgaatgtaataatggatttatgggggtatatatgtcaaaacttaccaaattgtacacttttgttatgtgcagtttattgtgtgtcaattatacctcaataaagttgttaaaaatat

SEQ ID NO: 127990 - DNA, 2222 bp, Homo sapiens
  Payload ID: 5063
  Gene Symbol: DMRT1
  Gene Name: doublesex and mab-3 related transcription factor 1
  Uniprot ID: Q9Y5R6
  ENST ID: ENST00000382276
  CDS Start-End: 150-1271
cctcgccactccagctgcgcctccggctgcagcgcacacgtctcctgcgcctcctcctccggagcgtcgctgtccgtcgggttcatccctcgcagcagtctccaggcgagagagggggccagagtgctcgcacttctcctaggggcaccatgcccaacgacgaggcattcagcaagccctctacaccgtcggaagcccctcacgcccccggggtaccgccgcagggcagagccgggggctttggcaaagcgtctggggcgctagtgggggcggccagcggctcgagcgccgggggcagcagcagaggaggcggctccggctccggggcgtcggacctgggtgccgggagcaagaagtccccgcggctgcccaagtgcgcacgctgcaggaaccacggctacgcctcgccgctcaagggccacaagcgcttctgcatgtggcgcgactgccagtgcaagaagtgcaacctgatcgccgagaggcagcgcgtgatggccgcgcaggtggccctgagaaggcagcaggcccaggaggaggaattgggtatcagccaccccatcccactgcccagtgcggccgagctgcttgtcaaaagagagaacaatggcagtaacccgtgcctcatgactgagtgcagtggcacctctcagccaccgccggccagtgtccccaccactgcagcttcagagggacgtatggtcatccaggatattcctgctgtcaccagcagagggcatgtggagaacacacctgacctggtttcagactccacctactacagcagcttctaccagccgtctctgtttccttattacaacaatctatacaactgcccgcagtactccatggccttggctgctgattctgcttctggggaggtgggaaatcccctcgggggatcccctgtgaagaacagccttcggggcctccccggaccttatgtgcctggtcagacaggaaaccagtggcagatgaagaacatggagaaccgccatgcaatgagctcccagtacaggatgcattcttactacccgcctccctcttacctgggccagagcgtgccccagttcttcacttttgaggatgctccctcttacccggaagccagggcgagcgtattctcgccgcccagcagtcaagattctggcttggtttccctctcgagcagctctcctattagtaacaagagcacaaaggcagtgcttgaatgtgagcctgcgtcggagcccagcagcttcacagtcactcccgtcatcgaggaggacgagtgagcagtgcctgctgccgatggcggttcacttggagtaacaggcttattccactttccatggggtttgttaatattttgcattgactcatactatcttaactgttgagaacgtatttggtttatattccttagagtttagtccagaggctgtaacacatttgtaatactttagggtccgtgactaccatctgcatggtttaagtgctttactcacggagtttaaataatagtgttcatttttttaatgacactggtttcatgtagttttcaagaaataaaagaattcattcaagtgaagccatttgtgtgcctctaaatgagtcatctaattagatgttacttttagttttaaaatgaaatcttaggtgccttaggggttttttttttttttaagtattttttaaaaacctgcaaagatataaatttagccaagttacctgacgggtgagaagaaaagagcaggcaaaattagtgatttttttagaagtctgctaaatggatatattgtgtgtgttgctgttggaaatagccccaccccatcctcccaatccaaaacgtaactgaaatataatcagaaacattaaagcctgtaaaaaaaaattgctgcgtttttggtaaagggtgtaatttgtaaacagtgcaatttaaagtgaccttagtgatgcagagttcctgagtggtgtttgtagaatgagtttatcatacattctttctactactggaaaaaaatggatgcagtctggactgttgtaaccttaggttgtaatctgatttggaaataagtacatctttaaaagttgctacagatttgagttcatgattttgttaaaaattgctatggagtactttgttatataacagaagccatcctgaaatgaaactagtctaaaaaaattcattgttctacttagttgcagctgtacctgaaataaaaatgttattgatgactgaa

SEQ ID NO: 127991 - DNA, 1385 bp, Homo sapiens
  Payload ID: 5063
  Gene Symbol: DMRT1
  Gene Name: doublesex and mab-3 related transcription factor 1
  ENST ID: ENST00000569227
  CDS Start-End: 362-1009
agagttgcgggcttcgctcggctcggggttccccacgatctctcaccctgtgtttcggcggagttgcgggggttccctctgctcccgggtccctgagatccctgatcccgctctcagggcagggaattccggggttcgcccctctgggcttccccgcgatcccagagcccgcgttccaacagaattgggagggtttattgcgctagaggagtcttcaggatcttcgctcccgccctccgaggtggccctgagaaggcagcaggcccaggaggaggaattgggtatcagccaccccatcccactgcccagtgcggccgagctgcttgtcaaaagagagaacaatggcagtaacccgtgcctcatgactgagtgcagtggcacctctcagccaccgccggccagtgtccccaccactgcagcttcagagggacgtatggtcatccaggatattcctgctgtcaccagcagagggcatgtggagaacacacctgacctggtttcagactccacctactacagcagcttctaccagccgtctctgtttccttattacaacaatctatacaactgcccgcagtactccatggccttggctgctgattctgcttctggggaggtgggaaatcccctcgggggatcccctgtgaagaacagccttcggggcctccccggaccttatgtgcctggtcagacaggaaaccagtggcagatgaagaacatggagaaccgccatgcaatgagctcccagtacaggatgcattcttactacccgcctccctcttacctgggccagagcgtgccccagttcttcacttttgaggatgctccctcttacccggaagccagggcgagcgtattctcgccgcccagcagtcaagattctggcttggtttccctctcgagcagctctcctattagtaacaagagcacaaaggcagtgcttgaatgtgagcctgcgtcggagcccagcagcttcacagtcactcccgtcatcgaggaggacgagtgagcagtgcctgctgccgatggcggttcacttggagtaacaggcttattccactttccatggggtttgttaatattttgcattgactcatactatcttaactgttgagaacgtatttggtttatattccttagagtttagtccagaggctgtaacacatttgtaatactttagggtccgtgactaccatctgcatggtttaagtgctttactcacggagtttaaataatagtgttcatttttttaatgacactggtttcatgtagttttcaagaaataaaagaattcattcaagtgaagccatttgtgtgcctctaaatgagtcatctaattagatgttacttttagttttaaaatgaaatcttaggtgccttagggg

SEQ ID NO: 127992 - DNA, 2459 bp, Homo sapiens
  Payload ID: 5064
  Gene Symbol: DMRT2
  Gene Name: doublesex and mab-3 related transcription factor 2
  Uniprot ID: Q9Y5R5
  ENST ID: ENST00000259622
  CDS Start-End: 1-681
atggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaagttctccttggattattctacagctattatgtgtacataatgaaccatctttagaaaataaaagtgacatcagctctaggtatagatatattttttaataatgaaaaaagatgacatggataataataaaacattgattgatacaagataaatagtcttgtctcttaatgcgtagggggcctgggaagaatattaaaattttaatcaataaagtatgtctgttgaagcaagcaagcaaacaaatccataacaaccacaacaagcaacaagaacaagaacaacaacaagaagaagttgcagtatggatatctttcaccctcccaggaaactctttcaaacctaatctgtacttttgcatctgtataaaaatatcagtgagatggaactgtaaataattgttctgctgatctgtagtgttgctgttaccttctgggtttccacatttttattccgtagatgttaatctctttcatgtgcaatctttgcttcttgtaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaagacccaa

SEQ ID NO: 127993 - DNA, 1495 bp, Homo sapiens
  Payload ID: 5064
  Gene Symbol: DMRT2
  Gene Name: doublesex and mab-3 related transcription factor 2
  ENST ID: ENST00000302441
  CDS Start-End: 1-1218
atggccgacccgcaggctggctccgcggccggggactgggagatcgatgccaccgaggacaagaaggggctttccgggaaacagaataatttcgagcgcaaagctgtgtaccagaggcaagtcagagcccccagtttgctggccaaaagcattttagaaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaagaccc

SEQ ID NO: 127994 - DNA, 1965 bp, Homo sapiens
  Payload ID: 5064
  Gene Symbol: DMRT2
  Gene Name: doublesex and mab-3 related transcription factor 2
  Uniprot ID: Q9Y5R5
  ENST ID: ENST00000358146
  CDS Start-End: 1-1686
atggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaagacccaa

SEQ ID NO: 127995 - DNA, 2292 bp, Homo sapiens
  Payload ID: 5064
  Gene Symbol: DMRT2
  Gene Name: doublesex and mab-3 related transcription factor 2
  Uniprot ID: Q9Y5R5
  ENST ID: ENST00000382251
  CDS Start-End: 330-2015
gccagtggcgctgcgctgaatgcaactgcgcgcgcccgccgggtgagccagcgatctgagccaggcgggggcggcccgacctttcccgcccagcctgggtcagaggaagccgaaagcggcctcagcaagtgggttcgttccgggcctccagctatcagctcccgatctcgtgtttgagggtagcgaccccgatttctgtttgcatgcacagccagcagccctagcgccagatcctaaagctggatatcttttaactgggctaccagcccgggcctcaaagttttgagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaagaccc

SEQ ID NO: 127996 - DNA, 2367 bp, Homo sapiens
  Payload ID: 5064
  Gene Symbol: DMRT2
  Gene Name: doublesex and mab-3 related transcription factor 2
  Uniprot ID: Q9Y5R5
  ENST ID: ENST00000382255
  CDS Start-End: 330-1010
gccagtggcgctgcgctgaatgcaactgcgcgcgcccgccgggtgagccagcgatctgagccaggcgggggcggcccgacctttcccgcccagcctgggtcagaggaagccgaaagcggcctcagcaagtgggttcgttccgggcctccagctatcagctcccgatctcgtgtttgagggtagcgaccccgatttctgtttgcatgcacagccagcagccctagcgccagatcctaaagctggatatcttttaactgggctaccagcccgggcctcaaagttttgagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaagttctccttggattattctacagctattatgtgtacataatgaaccatctttagaaaataaaagtgacatcagctctaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaaga

SEQ ID NO: 127997 - DNA, 1244 bp, Homo sapiens
  Payload ID: 5064
  Gene Symbol: DMRT2
  Gene Name: doublesex and mab-3 related transcription factor 2
  Uniprot ID: Q9Y5R5
  ENST ID: ENST00000412350
  CDS Start-End: 466-1146
ccagtggcgctgcgctgaatgcaactgcgcgcgcccgccgggtgagccagcgatctgagccaggcgggggcggcccgacctttcccgcccagcctgggtcagaggaagccgaaagcggcctcagcaaggtgaggcgcccgaggctgcagaagaccgagcagaactttgcagagttcgggatgtgctgggctaggtcgctgaggacttgactggcttcctccctccttccctccacctaccttctccctccccctccaccatccagtgggttcgttccgggcctccagctatcagctcccgatctcgtgtttgagggtagcgaccccgatttctgtttgcatgcacagccagcagccctagcgccagatcctaaagctggatatcttttaactgggctaccagcccgggcctcaaagttttgagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaagttctccttggattattctacagctattatgtgtacataatgaaccatctttagaaaataaaagtgacatcagctctaggtatagatatattttttaataatgaaaaaagatgacatggataataataaaacattgattgatacaagataaa

SEQ ID NO: 127998 - DNA, 2190 bp, Homo sapiens
  Payload ID: 5064
  Gene Symbol: DMRT2
  Gene Name: doublesex and mab-3 related transcription factor 2
  ENST ID: ENST00000635183
  CDS Start-End: 670-1350
attgatgtactcttgcaggagaaagaaggatgtcgctgtacgccccgaaagagaggcatcatttttacgcccagtttggattaatgattgattgagtcgcagaaatgcttgtgatgctgatagaggccaatactggtctttctgatctcttcctcgtcgtttattaccttctcttgtggacaacgcattcctaagaatgtatctctgcttgtttcccagtccgcgagataaatggtgacttctctcttgcaggcaccgtcatacctcgggtttagattctggacaggcgagccggctgcaccgaaggcccggtaggcggactctggcggagcgcttcagagagaagagtgtagaccgcgggaggcggagggctccctgccagcgtgcctcggccaatcagtattcacaccgcctgacaaccggccaatcagaggacgtaaagctccggggcctgagcggacagtactaggaaggggagcgcagtctgcagactgaagccagtggcgctgcgctgaatgcaactgcgcgcgcccgccgggtgagccagcgatctgagccaggcgggggcggcccgacctttcccgcccagcctgggtcagaggaagccgaaagcggcctcagcaagagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaagttctccttggattattctacagctattatgtgtacataatgaaccatctttagaaaataaaagtgacatcagctctaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtca

SEQ ID NO: 127999 - DNA, 2183 bp, Homo sapiens
  Payload ID: 5065
  Gene Symbol: DMRT3
  Gene Name: doublesex and mab-3 related transcription factor 3
  Uniprot ID: Q9NQL9
  ENST ID: ENST00000190165
  CDS Start-End: 39-1457
ccgcagccaggctgccaactcattcgggagcccggggcatgaacggctacggctccccctacctgtacatgggcggcccggtgtcgcagccgccacgggcgcccctgcagcgcacgcccaagtgcgcgcgctgccgcaaccatggcgtcctgtcctggctcaagggccacaagcgttactgccgcttcaaggactgcacctgcgagaagtgcatcctcatcatcgagcggcagcgggtcatggctgcgcaggtggcgctgcgccggcagcaggccaacgagagcttggagagcctcatccccgactcgctgcgcgctctgccagggcccccgccgccgggggacgccgtcgccgccccgcagccgccgccagcctctcagccgtcgcagccgcagccgccgcgccctgctgccgagttggccgcggccgccgcgctgcgttggactgccgagccgcagcccggggctctgcaggcgcagctcgccaagccagatttgactgaagaacgacttggagacggcaagtcggcagacaatacagaggtcttcagtgacaaagacactgaccagaggagttccccagatgtggcaaagagtaagggctgcttcacccctgagagccctgagatagtgtccgtggaggaagggggatacgctgtccagaaaaacggaggcaaccccgagagccgccctgacagccccaagtgtcacgcggagcagaatcacctcctgattgagggcccctcggggactgtttctctgcccttcagcttgaaagccaacagaccgccgcttgaagtgttaaaaaagatattccccaaccagaagccaacggtgcttgagctcatcctcaagggctgtggcggggacctggtgagcgccgtggaagtccttctgtccagccgatcctcagtcacgggagcagagcgaacttccgcagaacctgagagtctagcgttgccctccaatgggcacatctttgaacacaccttgagctcctaccccatctcgtcttccaaatggtctgtgggatcagcctttcgagtcccagacacgttgaggttttctgccgactctagcaacgttgtccccagtcccttggctgggcctctgcagccccctttcccccagccaccccggtacccgctgatgctgaggaatactttggcgagaagccagtcgagcccctttttgcccaatgatgtcaccctgtggaacaccatgacgctgcagcagcagtatcagctgaggtcccagtatgtcagtcctttccccagtaactctaccagcgtcttcagaagctcgcccgtccttcctgcccgcgccacggaagaccctcggatttccatccctgatgatgggtgtccatttgtgtcaaagcagtccatttacaccgaggacgactatgacgagaggtctgactcctcagactctagaacactcaacacatcatcttaaagtggtgctggatgggtggtggccaggtgacattttctgtgcgttttgaccctgaggcatctgaggagaggccacatcttgtgtatgccctttccttctgtttgacaaagtgactgtgcttgattctatacattagcaataaaaacataacttatttaacttcttgcacttcactggaaaatgccaaatagctctgttctgtggctttagtgctgaatgtttattgtaaaagagagtctaatgttaagaatagtcttgggaaggctgggtccgtggaagatttatttggggatgtaaagctgaaggtcagccttgcacctaaacccaacctggaatgttaaatgaaataatatacttgaatgcaattttgtaaaagtggattcctcaggatatgtgaaacctaaaggaagtggttctgttgcaaatggactataaacagggacattatattcttacactaaaaatccttgcattttaaagagagatgcacttaagaatagagtgaactgctcatatgcttatttaagcttggacagttttcagagacaaaccccattaagaattactcttttcacatggctgaatcgaaacatgtgtaatgtcaatgtaaaaccaatcacagctgtgaactgcatgaaatgtattgtgaaacgaacacaagattaagctttgtcaggttaatgtagcatgttaaggactctagaaaaaaataaactaaggagacga

SEQ ID NO: 128000 - DNA, 497 bp, Homo sapiens
  Payload ID: 5065
  Gene Symbol: DMRT3
  Gene Name: doublesex and mab-3 related transcription factor 3
  ENST ID: ENST00000417254
  CDS Start-End: 162-497
tgatttctagatctttatttacagggtttttgtttcatttgccagtgatatagttcgaatttttttaaaaaggcttgtagtatattatgacccattgagatgcatttgctcttccaaaaagcacgtgtacaggtctcttctgagcacatctgctcctctttatgcacaccaggaaaagattaactcagctgttctgttttccagatttgactgaagaacgacttggagacggcaagtcggcagacaatacagaggtcttcagtgacaaagacactgaccagaggagttccccagatgtggcaaagagtaagggctgcttcacccctgagagccctgagatagtgtccgtggaggaagggggatacgctgtccagaaaaacggaggcaaccccgagagccgccctgacagccccaagtgtcacgcggagcagaatcacctcctgattgagggcccctcggggactgtttctctgcccttcagcttgaaagccaacaga

SEQ ID NO: 128001 - DNA, 8552 bp, Homo sapiens
  Payload ID: 5066
  Gene Symbol: DSCAM
  Gene Name: Down syndrome cell adhesion molecule
  Uniprot ID: O60469
  ENST ID: ENST00000400454
  CDS Start-End: 479-6517
agggaaggttggcagagggatccatgtgactgaggccggagcacggcaaagatgagcctgcccgcccgcctgctgcctggatgcggagggtgagggctggcgcacgggaggccgctggctgcgcattctgggcgccgagtgcccgggatgagctcacgcccgcgtctgcggctctctccacctgccgacctgccgggggcccactgagctgacggcgcacctgggctccggccgcagcgtggggcgcggcgcccgggagcaggtgtgcaggagcgcagcgcgcggcgagcgcagccctcgctccggagcccggccgcgccgcgtgcccgggcggctaggcagcggcggcggcggcggcgggcggcgggcgggcggcggcccccgggcaggtgccgagcggcgagcggagccgggccgggcggagcgcggggggcgaggccggcgcgtcgctcgcgggaggccggggagcggcaggggcatgtggatactggctctctccttgttccagagcttcgcgaatgttttcagtgaagacctacactccagcctctactttgtcaatgcatctctgcaagaggtagtgtttgccagcaccacggggactctggtgccctgccccgcagcaggcatccctcctgtgactctcagatggtacctagccacgggcgaggagatctacgatgtccccgggatccgccacgtccaccccaacggcactctccaaattttccccttccctccttcaagcttcagtaccttaatccatgataatacttattattgcacagctgaaaatccttcagggaaaattagaagtcaggatgtccacatcaaggctgttttacgggagccctatacagtccgtgtggaggaccagaaaaccatgagaggcaatgttgcggtcttcaagtgcattatcccctcctcggtggaggcgtacatcactgtcgtctcatgggagaaagacactgtttcacttgtctcaggatctagatttctcatcacatccacgggagccttgtatattaaagatgtacagaatgaagatggattgtataactaccgctgcatcacgcggcatcgatacaccggagagacgaggcagagcaacagcgccagactttttgtatcagacccagcgaactcagccccatccatactggatgggtttgaccatcgcaaagccatggctgggcagcgtgtggagctgccttgcaaagcgctcgggcaccctgagccagattaccgctggctgaaggacaacatgcccctggaactttcagggaggttccagaagaccgtgacggggctgctcattgagaacattcgcccctcggactcaggcagctatgtttgtgaagtgtccaacagatacggaactgctaaggtgataggccgcctgtacgtgaaacagccactgaaagccaccatcagtcccaggaaggttaaaagcagcgtgggtagccaagtttccttgtcctgcagcgtgacaggaactgaggaccaggaactctcctggtaccgcaatggtgaaatcctcaaccctggaaaaaatgtgaggatcacagggatcaaccacgaaaaccttataatggatcacatggtcaaaagtgacgggggcgcataccagtgctttgtgcgcaaggacaagctgtccgctcaagactatgtgcaggtggtccttgaagatggaactcccaaaattatttctgcctttagtgaaaaggtggtgagtccagcagagccggtttcccttatgtgcaacgtgaagggaacacctttgcccacgatcacgtggaccctggacgatgacccgattctcaagggtggcagtcaccgcatcagccagatgatcacgtcggaggggaacgtggtcagctacctgaacatctccagctcccaggtccgggacgggggagtctaccgctgcactgccaacaactcggcgggagtcgtcctgtaccaggctcgaataaacgtaagagggcctgcaagcattcgaccaatgaaaaacatcacagcaatagcaggacgggacacatacattcactgtcgtgtgattggctatccgtattactccattaaatggtacaagaactctaacctgcttcctttcaaccaccgccaagtggcatttgagaacaatggaactcttaaactttcagatgtgcaaaaggaagtggacgagggggagtacacgtgcaacgtgttggttcaaccacaactctccaccagccagagcgtccacgtgaccgtgaaagttccgcctttcatacaaccctttgagtttccaagattctccattgggcagcgggtcttcatcccctgtgttgtggtctcaggggacttacccatcacgatcacctggcagaaggatggccggccaatccctgggagccttggggtgaccattgacaatattgacttcacgagctccttgaggatttccaatctctcgctcatgcacaatgggaattacacctgcatagcccggaatgaggccgccgctgtggagcaccaaagccagttgattgtcagagttcctcccaagtttgtggttcagccacgggaccaggacgggatttatggcaaagcagtcatcctcaattgttctgctgagggttaccctgtacctaccatcgtgtggaaattctctaaaggtgctggggttccccagttccagccaattgccctaaatggccgaatccaagttctcagcaatgggtcgttgctgatcaagcatgtcgtggaggaagacagtggctactacctctgcaaggtcagcaacgatgtgggcgcagacgtcagcaagtccatgtacctcacggttaaaattcctgcgatgataacatcctatccaaatactaccctggccacgcaggggcagaaaaaggagatgagctgcacggcgcatggtgagaagcccattatagtccgctgggagaaggaggaccgaatcattaaccctgagatggcccgttatcttgtgtccaccaaggaggtgggagaagaggtgatttctactctgcagattttgccaactgtgagagaagattctggtttcttttcctgccatgctattaattcttatggggaggaccgtggaataattcagctcacagtgcaagagcccccagaccctcccgaaattgagatcaaagatgtcaaagcacgcacaattacgctcaggtggaccatggggtttgatggaaacagtcccatcacaggctacgatattgaatgcaaaaataaatcagactcctgggattctgctcagagaaccaaagatgtttcccctcagctgaactcggccaccatcattgatatccacccttcctccacctacagcatccgcatgtacgccaagaaccggattggcaagagcgagcccagcaacgagctcaccatcacggcggacgaggcagctcctgatggtccacctcaggaagttcacctggagcctatatcatctcagagcatcagggtcacatggaaggctcccaagaaacatttgcaaaatgggattatccgtggctaccaaataggttaccgagagtacagcactgggggtaacttccaattcaacattatcagtgtcgacaccagcggggacagtgaggtttacaccctggacaacctgaataagttcactcagtacggcctggtggtgcaggcctgtaaccgggccggcacggggccttcttctcaggaaatcatcaccaccactctcgaggatgtgcccagttacccccccgaaaatgtccaagccatagcaacatcaccagaaagcatatcaatatcctggtccacactttccaaggaagccttgaatggaattctccaggggttcagagtcatttactgggccaacctcatggacggagagctgggtgagattaaaaacatcaccaccacacagccttcactggagctggacgggctggaaaagtacaccaactacagcatccaggtgctggccttcacccgcgcaggagacggggtcaggagtgagcagatcttcacccggaccaaagaggatgttccaggtcctcccgcgggtgtgaaggcagcggcggcctcagcctccatggtctttgtgtcctggcttccccctctcaagctgaacggcatcatccgaaagtacactgtattctgctcccacccctatcccacagtgatcagcgagtttgaggcctctcccgactcgttttcctacagaattcccaacctgagtaggaatcgtcagtacagcgtctgggtggtggctgttacttcagccggaagaggcaacagcagtgaaatcatcacagtcgagccactagcaaaagctcctgcacgaatcctgaccttcagtgggacagtgactactccatggatgaaagacattgtcttgccttgtaaggctgttggggacccttctcctgcagtcaaatggatgaaagacagtaacgggacacccagtctagtaacgattgatgggcggaggagcatctttagcaacggaagcttcattattcgcacggtgaaagcagaagactccggctattacagctgcattgccaataacaactggggatctgatgaaattattttaaacttacaagtacaagttccaccagatcagcctcggcttacagtctccaagaccacgtcttcctccatcaccctttcttggctccctggagacaacgggggcagctctatcagaggatacatactgcagtactccgaggacaatagtgagcagtgggggagttttccaatcagccccagcgaacgttcctatcgcttggaaaatctcaaatgtgggacttggtataagttcacactgacagcccaaaatggagtgggcccagggcgcataagtgaaatcatagaagcaaagaccttaggaaaagagccccagttctcaaaggagcaggagctgtttgccagcatcaacaccacacgcgtgaggctgaacctcattggctggaatgatggcggctgccccatcacctccttcacactagagtacaggccctttgggaccacagtttggaccacagctcagaggacctctctctccaagtcctacatcctgtatgacctgcaggaagccacctggtatgagctgcagatgcgggtgtgcaacagtgcgggctgcgcggagaagcaggccaacttcgctacgctgaactacgatggcagtacaattcctccactcattaagtcagttgtccaaaacgaagaagggctgacgaccaacgaggggctcaagatgctggtgaccatctcctgtatcctggtgggggtcttgctgctgtttgtgctcctgctggttgtgcggaggaggcggcgggagcagaggctaaagaggctgcgagatgcaaagagtttagctgaaatgctcatgagtaagaatacccggacttcagatacgttaagcaagcaacagcagaccctgcgaatgcacatcgacatacccagggctcagcttttgattgaagagagagacacgatggagaccattgatgatcgctccacggttctgttgacggatgctgactttggagaggcagctaagcagaagtccctgacggtcactcacacggtccattaccaatcggtgtctcaggccactgggcccttagtggatgtttcagacgctcggccgggaacgaatcccaccaccaggaggaatgccaaggctgggcccacagcgagaaaccgctatgccagccagtggaccctcaaccgaccccaccccaccatctcagcacacaccctcaccacagactggaggctgccaacacccagggctgcaggatcagtagacaaagagagcgacagttacagcgtcagcccctcgcaagacacagatcgagcaagaagcagcatggtctccacagaaagtgcctcctccacttacgaagaactggccagggcctacgaacacgccaagatggaagagcaactgaggcacgccaagttcaccatcacggagtgcttcatatcagacacgtcatcggagcagttgacggcagggacaaatgagtacacggacagtctgacctccagcaccccttccgaatcgggaatctgcaggttcactgcatctccccccaaacctcaggatggaggaagagtaatgaatatggcagttccaaaggcacatcggccaggtgacctcatacatttgcctccataccttagaatggactttttgttaaaccgaggtggtccaggcaccagcagggacctgagcttaggacaagcatgcttggaacctcagaaaagccggaccctgaagcgccccacggtcctggagcccatcccgatggaagccgcctcctccgcctcctccacgagagaaggacagtcgtggcagccgggggccgtggccacattacctcagcgggagggagcagagctgggacaggcagctaaaatgagcagctcccaagaatcactgctcgactcccggggccatttgaaaggaaacaatccttacgcaaaatcttacaccctggtataacagacagcatgactggacagcggttgtaaatacaattcaaacaattcaatcaaagctaccttttttttacggaattccaatatttataattaaagaaaattgccaaaatatattaaaaaaaaaaaagagaaaatactgaaaccacagacagtgcaaagactctcctgctttttttctgtctgagtgtgagctccatccgcctgggcatctgattttttgggaaagaagtccagttttatgatcttcacaggctattgcatttttactgattttctacaaaagtgcatgggggggattaattaaaccttctgactggaagttctatcacacaagaggcaagaaagaaaacagggtgggtgggaaatcagcctatttgtgaatttaaaaggaacaccgatttgcgggcaggggaaaacttcagtcacgtttgcacacctttctttcccattagaaaccgggttctcaatttggtcttcttttgttgttaattaggatgagtgccgtcagtgaaggggtggggggaatcaatttggttttctctcttgtttcttttttaatttaatgagacactctttgcattttgtctaagcgaaataaaaaagaaaaggttgtctgcctttatttccatgtctgcttctctcgtcttctgccagtggcctggtcctccttcccattgacacttctgtttggaaacaccaggcctgaacccagagcccaattcaataaaccagagtcgatactaacaccctgaactcctcaggaatctccaggaagcacaaagaaggtgcagctcctgctctcaagctggagaggacaaaatgcaggctggtctccaccgcaaccagaggccagcccaagtattcgaagcccgtcgcaaagctctgccccttgcctgcccatggccagagttcaactgactgtggcctatgggccaaatccagcctcctgctgttttttaaataaagttttattgaaacaaggccacatgcactatttgctattgtctatggctgctttcatggcacaatggtagagctgaatagttgcagcagagatggtatagcccatgaagcctaaaatatttattacctggcccattacaggaaacatttgccagacccgtgctctggagtctgaaatgtagccccagcttgcgtgacaaggggcaagatcgtgcatcttaccctccatgacttttcctatctccactatgcctggtatgcaaatttgtgatagaccatcttaataaacattgcctgaatcctctgtaaccagaggaaagtgatgttcctctaaaatctaagtttttactttcctttccctcactttatctcccatgtggctcatcctaagagagaatttactcataaatagtcggaactgcattctttatcccacaaccctcacagggtttgctttatgaaagaggatgtaatcctcccctggctgcaacactccattccaggctcacttccataaaatggaaagataaacaggtctttgtgtcagagatttggcattaaccagaaaacatgatcaaatatccacagctgctcagtctcccaggctgaagattctctacaggcttccattaaggccaccaacatagactggtgccagttattaccatcttgggaacatattcagaaatgtctttccttccctccctccctccttctttcccatcctttcttccttctatttattttccaggcaggcccatttgtctgcttagattcagtgacacagaatgggtccaggaccatgtcaagaccacctgctgatgctagtgttagatgactccaggaatgtgaggtgtgcatccatggtttcagaatgtaatccgtgttgacgtgtactgtttgcatactctcagactgttttttttttatgcaaaagaaatgttactttctgggggaaaaaattaaaagtctatctttcatcaacctaaaacttctatatcccccaaacatagaagtttacctttttaacatttttctctcaacctgtacaaaaataaaaaaattctacatta

SEQ ID NO: 128002 - DNA, 5374 bp, Homo sapiens
  Payload ID: 5066
  Gene Symbol: DSCAM
  Gene Name: Down syndrome cell adhesion molecule
  ENST ID: ENST00000404019
  CDS Start-End: 1-5241
ctcgggcaccctgagccagattaccgctggctgaaggacaacatgcccctggaactttcagggaggttccagaagaccgtgacggggctgctcattgagaacattcgcccctcggactcaggcagctatgtttgtgaagtgtccaacagatacggaactgctaaggtgataggccgcctgtacgtgaaacagccactgaaagccaccatcagtcccaggaaggttaaaagcagcgtgggtagccaagtttccttgtcctgcagcgtgacaggaactgaggaccaggaactctcctggtaccgcaatggtgaaatcctcaaccctggaaaaaatgtgaggatcacagggatcaaccacgaaaaccttataatggatcacatggtcaaaagtgacgggggcgcataccagtgctttgtgcgcaaggacaagctgtccgctcaagactatgtgcaggtggtccttgaagatggaactcccaaaattatttctgcctttagtgaaaaggtggtgagtccagcagagccggtttcccttatgtgcaacgtgaagggaacacctttgcccacgatcacgtggaccctggacgatgacccgattctcaagggtggcagtcaccgcatcagccagatgatcacgtcggaggggaacgtggtcagctacctgaacatctccagctcccaggtccgggacgggggagtctaccgctgcactgccaacaactcggcgggagtcgtcctgtaccaggctcgaataaacgtaagagggcctgcaagcattcgaccaatgaaaaacatcacagcaatagcaggacgggacacatacattcactgtcgtgtgattggctatccgtattactccattaaatggtacaagaactctaacctgcttcctttcaaccaccgccaagtggcatttgagaacaatggaactcttaaactttcagatgtgcaaaaggaagtggacgagggggagtacacgtgcaacgtgttggttcaaccacaactctccaccagccagagcgtccacgtgaccgtgaaagttccgcctttcatacaaccctttgagtttccaagattctccattgggcagcgggtcttcatcccctgtgttgtggtctcaggggacttacccatcacgatcacctggcagaaggatggccggccaatccctgggagccttggggtgaccattgacaatattgacttcacgagctccttgaggatttccaatctctcgctcatgcacaatgggaattacacctgcatagcccggaatgaggccgccgctgtggagcaccaaagccagttgattgtcagagttcctcccaagtttgtggttcagccacgggaccaggacgggatttatggcaaagcagtcatcctcaattgttctgctgagggttaccctgtacctaccatcgtgtggaaattctctaaaggtgctggggttccccagttccagccaattgccctaaatggccgaatccaagttctcagcaatgggtcgttgctgatcaagcatgtcgtggaggaagacagtggctactacctctgcaaggtcagcaacgatgtgggcgcagacgtcagcaagtccatgtacctcacggttaaaattcctgcgatgataacatcctatccaaatactaccctggccacgcaggggcagaaaaaggagatgagctgcacggcgcatggtgagaagcccattatagtccgctgggagaaggaggaccgaatcattaaccctgagatggcccgttatcttgtgtccaccaaggaggtgggagaagaggtgatttctactctgcagattttgccaactgtgagagaagattctggtttcttttcctgccatgctattaattcttatggggaggaccgtggaataattcagctcacagtgcaagagcccccagaccctcccgaaattgagatcaaagatgtcaaagcacgcacaattacgctcaggtggaccatggggtttgatggaaacagtcccatcacaggctacgatattgaatgcaaaaataaatcagactcctgggattctgctcagagaaccaaagatgtttcccctcagctgaactcggccaccatcattgatatccacccttcctccacctacagcatccgcatgtacgccaagaaccggattggcaagagcgagcccagcaacgagctcaccatcacggcggacgaggcagctcctgatggtccacctcaggaagttcacctggagcctatatcatctcagagcatcagggtcacatggaaggctcccaagaaacatttgcaaaatgggattatccgtggctaccaaataggttaccgagagtacagcactgggggtaacttccaattcaacattatcagtgtcgacaccagcggggacagtgaggtttacaccctggacaacctgaataagttcactcagtacggcctggtggtgcaggcctgtaaccgggccggcacggggccttcttctcaggaaatcatcaccaccactctcgaggatgtgcccagttacccccccgaaaatgtccaagccatagcaacatcaccagaaagcatatcaatatcctggtccacactttccaaggaagccttgaatggaattctccaggggttcagagtcatttactgggccaacctcatggacggagagctgggtgagattaaaaacatcaccaccacacagccttcactggagctggacgggctggaaaagtacaccaactacagcatccaggtgctggccttcacccgcgcaggagacggggtcaggagtgagcagatcttcacccggaccaaagaggatgttccaggtcctcccgcgggtgtgaaggcagcggcggcctcagcctccatggtctttgtgtcctggcttccccctctcaagctgaacggcatcatccgaaagtacactgtattctgctcccacccctatcccacagtgatcagcgagtttgaggcctctcccgactcgttttcctacagaattcccaacctgagtaggaatcgtcagtacagcgtctgggtggtggctgttacttcagccggaagaggcaacagcagtgaaatcatcacagtcgagccactagcaaaagctcctgcacgaatcctgaccttcagtgggacagtgactactccatggatgaaagacattgtcttgccttgtaaggctgttggggacccttctcctgcagtcaaatggatgaaagacagtaacgggacacccagtctagtaacgattgatgggcggaggagcatctttagcaacggaagcttcattattcgcacggtgaaagcagaagactccggctattacagctgcattgccaataacaactggggatctgatgaaattattttaaacttacaagtacaagttccaccagatcagcctcggcttacagtctccaagaccacgtcttcctccatcaccctttcttggctccctggagacaacgggggcagctctatcagaggatacatactgcagtactccgaggacaatagtgagcagtgggggagttttccaatcagccccagcgaacgttcctatcgcttggaaaatctcaaatgtgggacttggtataagttcacactgacagcccaaaatggagtgggcccagggcgcataagtgaaatcatagaagcaaagaccttaggaaaagagccccagttctcaaaggagcaggagctgtttgccagcatcaacaccacacgcgtgaggctgaacctcattggctggaatgatggcggctgccccatcacctccttcacactagagtacaggccctttgggaccacagtttggaccacagctcagaggacctctctctccaagtcctacatcctgtatgacctgcaggaagccacctggtatgagctgcagatgcgggtgtgcaacagtgcgggctgcgcggagaagcaggccaacttcgctacgctgaactacgatggcagtacaattcctccactcattaagtcagttgtccaaaacgaagaagggctgacgaccaacgaggggctcaagatgctggtgaccatctcctgtatcctggtgggggtcttgctgctgtttgtgctcctgctggttgtgcggaggaggcggcgggagcagaggctaaagaggctgcgagatgcaaagagtttagctgaaatgctcatgagtaagaatacccggacttcagatacgttaagcaagcaacagcagaccctgcgaatgcacatcgacatacccagggctcagcttttgattgaagagagagacacgatggagaccattgatgatcgctccacggttctgttgacggatgctgactttggagaggcagctaagcagaagtccctgacggtcactcacacggtccattaccaatcggtgtctcaggccactgggcccttagtggatgtttcagacgctcggccgggaacgaatcccaccaccaggaggaatgccaaggctgggcccacagcgagaaaccgctatgccagccagtggaccctcaaccgaccccaccccaccatctcagcacacaccctcaccacagactggaggctgccaacacccagggctgcaggatcagtagacaaagagagcgacagttacagcgtcagcccctcgcaagacacagatcgagcaagaagcagcatggtctccacagaaagtgcctcctccacttacgaagaactggccagggcctacgaacacgccaagatggaagagcaactgaggcacgccaagttcaccatcacggagtgcttcatatcagacacgtcatcggagcagttgacggcagggacaaatgagtacacggacagtctgacctccagcaccccttccgaatcgggaatctgcaggttcactgcatctccccccaaacctcaggatggaggaagagtaatgaatatggcagttccaaaggcacatcggccaggtggtccaggcaccagcagggacctgagcttaggacaagcatgcttggaacctcagaaaagccggaccctgaagcgccccacggtcctggagcccatcccgatggaagccgcctcctccgcctcctccacgagagaaggacagtcgtggcagccgggggccgtggccacattacctcagcgggagggagcagagctgggacaggcagctaaaatgagcagctcccaagaatcactgctcgactcccggggccatttgaaaggaaacaatccttacgcaaaatcttacaccctggtataacagacagcatgactggacagcggttgtaaatacaattcaaacaattcaatcaaagctaccttttttttacggaattccaatatttataattaaagaaaattgccaaaatatattaaaaaaaaaaaagagaaaa

SEQ ID NO: 128003 - DNA, 6176 bp, Homo sapiens
  Payload ID: 5066
  Gene Symbol: DSCAM
  Gene Name: Down syndrome cell adhesion molecule
  ENST ID: ENST00000617870
  CDS Start-End: 13-5556
aagccactgttttcctctatttcaggatctagatttctcatcacatccacgggagccttgtatattaaagatgtacagaatgaagatggattgtataactaccgctgcatcacgcggcatcgatacaccggagagacgaggcagagcaacagcgccagactttttgtatcagacccagcgaactcagccccatccatactggatgggtttgaccatcgcaaagccatggctgggcagcgtgtggagctgccttgcaaagcgctcgggcaccctgagccagattaccgctggctgaaggacaacatgcccctggaactttcagggaggttccagaagaccgtgacggggctgctcattgagaacattcgcccctcggactcaggcagctatgtttgtgaagtgtccaacagatacggaactgctaaggtgataggccgcctgtacgtgaaacagccactgaaagccaccatcagtcccaggaaggttaaaagcagcgtgggtagccaagtttccttgtcctgcagcgtgacaggaactgaggaccaggaactctcctggtaccgcaatggtgaaatcctcaaccctggaaaaaatgtgaggatcacagggatcaaccacgaaaaccttataatggatcacatggtcaaaagtgacgggggcgcataccagtgctttgtgcgcaaggacaagctgtccgctcaagactatgtgcaggtggtccttgaagatggaactcccaaaattatttctgcctttagtgaaaaggtggtgagtccagcagagccggtttcccttatgtgcaacgtgaagggaacacctttgcccacgatcacgtggaccctggacgatgacccgattctcaagggtggcagtcaccgcatcagccagatgatcacgtcggaggggaacgtggtcagctacctgaacatctccagctcccaggtccgggacgggggagtctaccgctgcactgccaacaactcggcgggagtcgtcctgtaccaggctcgaataaacgtaagagggcctgcaagcattcgaccaatgaaaaacatcacagcaatagcaggacgggacacatacattcactgtcgtgtgattggctatccgtattactccattaaatggtacaagaactctaacctgcttcctttcaaccaccgccaagtggcatttgagaacaatggaactcttaaactttcagatgtgcaaaaggaagtggacgagggggagtacacgtgcaacgtgttggttcaaccacaactctccaccagccagagcgtccacgtgaccgtgaaagttccgcctttcatacaaccctttgagtttccaagattctccattgggcagcgggtcttcatcccctgtgttgtggtctcaggggacttacccatcacgatcacctggcagaaggatggccggccaatccctgggagccttggggtgaccattgacaatattgacttcacgagctccttgaggatttccaatctctcgctcatgcacaatgggaattacacctgcatagcccggaatgaggccgccgctgtggagcaccaaagccagttgattgtcagagttcctcccaagtttgtggttcagccacgggaccaggacgggatttatggcaaagcagtcatcctcaattgttctgctgagggttaccctgtacctaccatcgtgtggaaattctctaaaggtgctggggttccccagttccagccaattgccctaaatggccgaatccaagttctcagcaatgggtcgttgctgatcaagcatgtcgtggaggaagacagtggctactacctctgcaaggtcagcaacgatgtgggcgcagacgtcagcaagtccatgtacctcacggttaaaattcctgcgatgataacatcctatccaaatactaccctggccacgcaggggcagaaaaaggagatgagctgcacggcgcatggtgagaagcccattatagtccgctgggagaaggaggaccgaatcattaaccctgagatggcccgttatcttgtgtccaccaaggaggtgggagaagaggtgatttctactctgcagattttgccaactgtgagagaagattctggtttcttttcctgccatgctattaattcttatggggaggaccgtggaataattcagctcacagtgcaagagcccccagaccctcccgaaattgagatcaaagatgtcaaagcacgcacaattacgctcaggtggaccatggggtttgatggaaacagtcccatcacaggctacgatattgaatgcaaaaataaatcagactcctgggattctgctcagagaaccaaagatgtttcccctcagctgaactcggccaccatcattgatatccacccttcctccacctacagcatccgcatgtacgccaagaaccggattggcaagagcgagcccagcaacgagctcaccatcacggcggacgaggcagctcctgatggtccacctcaggaagttcacctggagcctatatcatctcagagcatcagggtcacatggaaggctcccaagaaacatttgcaaaatgggattatccgtggctaccaaataggttaccgagagtacagcactgggggtaacttccaattcaacattatcagtgtcgacaccagcggggacagtgaggtttacaccctggacaacctgaataagttcactcagtacggcctggtggtgcaggcctgtaaccgggccggcacggggccttcttctcaggaaatcatcaccaccactctcgaggatgtgcccagttacccccccgaaaatgtccaagccatagcaacatcaccagaaagcatatcaatatcctggtccacactttccaaggaagccttgaatggaattctccaggggttcagagtcatttactgggccaacctcatggacggagagctgggtgagattaaaaacatcaccaccacacagccttcactggagctggacgggctggaaaagtacaccaactacagcatccaggtgctggccttcacccgcgcaggagacggggtcaggagtgagcagatcttcacccggaccaaagaggatgttccaggtcctcccgcgggtgtgaaggcagcggcggcctcagcctccatggtctttgtgtcctggcttccccctctcaagctgaacggcatcatccgaaagtacactgtattctgctcccacccctatcccacagtgatcagcgagtttgaggcctctcccgactcgttttcctacagaattcccaacctgagtaggaatcgtcagtacagcgtctgggtggtggctgttacttcagccggaagaggcaacagcagtgaaatcatcacagtcgagccactagcaaaagctcctgcacgaatcctgaccttcagtgggacagtgactactccatggatgaaagacattgtcttgccttgtaaggctgttggggacccttctcctgcagtcaaatggatgaaagacagtaacgggacacccagtctagtaacgattgatgggcggaggagcatctttagcaacggaagcttcattattcgcacggtgaaagcagaagactccggctattacagctgcattgccaataacaactggggatctgatgaaattattttaaacttacaagtacaagttccaccagatcagcctcggcttacagtctccaagaccacgtcttcctccatcaccctttcttggctccctggagacaacgggggcagctctatcagaggatacatactgcagtactccgaggacaatagtgagcagtgggggagttttccaatcagccccagcgaacgttcctatcgcttggaaaatctcaaatgtgggacttggtataagttcacactgacagcccaaaatggagtgggcccagggcgcataagtgaaatcatagaagcaaagaccttaggaaaagagccccagttctcaaaggagcaggagctgtttgccagcatcaacaccacacgcgtgaggctgaacctcattggctggaatgatggcggctgccccatcacctccttcacactagagtacaggccctttgggaccacagtttggaccacagctcagaggacctctctctccaagtcctacatcctgtatgacctgcaggaagccacctggtatgagctgcagatgcgggtgtgcaacagtgcgggctgcgcggagaagcaggccaacttcgctacgctgaactacgatggcagtacaattcctccactcattaagtcagttgtccaaaacgaagaagggctgacgaccaacgaggggctcaagatgctggtgaccatctcctgtatcctggtgggggtcttgctgctgtttgtgctcctgctggttgtgcggaggaggcggcgggagcagaggctaaagaggctgcgagatgcaaagagtttagctgaaatgctcatgagtaagaatacccggacttcagatacgttaagcaagcaacagcagaccctgcgaatgcacatcgacatacccagggctcagcttttgattgaagagagagacacgatggagaccattgatgatcgctccacggttctgttgacggatgctgactttggagaggcagctaagcagaagtccctgacggtcactcacacggtccattaccaatcggtgtctcaggccactgggcccttagtggatgtttcagacgctcggccgggaacgaatcccaccaccaggaggaatgccaaggctgggcccacagcgagaaaccgctatgccagccagtggaccctcaaccgaccccaccccaccatctcagcacacaccctcaccacagactggaggctgccaacacccagggctgcaggatcagtagacaaagagagcgacagttacagcgtcagcccctcgcaagacacagatcgagcaagaagcagcatggtctccacagaaagtgcctcctccacttacgaagaactggccagggcctacgaacacgccaagatggaagagcaactgaggcacgccaagttcaccatcacggagtgcttcatatcagacacgtcatcggagcagttgacggcagggacaaatgagtacacggacagtctgacctccagcaccccttccgaatcgggaatctgcaggttcactgcatctccccccaaacctcaggatggaggaagagtaatgaatatggcagttccaaaggcacatcggccaggtgacctcatacatttgcctccataccttagaatggactttttgttaaaccgaggtggtccaggcaccagcagggacctgagcttaggacaagcatgcttggaacctcagaaaagccggaccctgaagcgccccacggtcctggagcccatcccgatggaagccgcctcctccgcctcctccacgagagaaggacagtcgtggcagccgggggccgtggccacattacctcagcgggagggagcagagctgggacaggcagctaaaatgagcagctcccaagaatcactgctcgactcccggggccatttgaaaggaaacaatccttacgcaaaatcttacaccctggtataacagacagcatgactggacagcggttgtaaatacaattcaaacaattcaatcaaagctaccttttttttacggaattccaatatttataattaaagaaaattgccaaaatatattaaaaaaaaaaaagagaaaatactgaaaccacagacagtgcaaagactctcctgctttttttctgtctgagtgtgagctccatccgcctgggcatctgattttttgggaaagaagtccagttttatgatcttcacaggctattgcatttttactgattttctacaaaagtgcatgggggggattaattaaaccttctgactggaagttctatcacacaagaggcaagaaagaaaacagggtgggtgggaaatcagcctatttgtgaatttaaaaggaacaccgatttgcgggcaggggaaaacttcagtcacgtttgcacacctttctttcccattagaaaccgggttctcaatttggtcttcttttgttgttaattaggatgagtgccgtcagtgaaggggtggggggaatcaatttggttttctctcttgtttcttttttaatttaatgagacactctttgcattttgtctaagcgaaataaaaaagaaaaggttgtctgccttt

SEQ ID NO: 128004 - DNA, 6899 bp, Homo sapiens
  Payload ID: 5067
  Gene Symbol: DSCAML1
  Gene Name: Down syndrome cell adhesion molecule like 1
  Uniprot ID: Q8TD84
  ENST ID: ENST00000321322
  CDS Start-End: 3-6344
ggatgacaggagccggggagccgaggagggaggagccgccgccgcagccgagcgctgggctgaggagcagagagagcggggcgccgagtgcgggcggctgggagcgcgctgagcgggggagaggcgctgccgcacggccggccacaggaccacctccccggagaatagggcctctttatggcatgtggctggtaactttcctcctgctcctggactctttacacaaagcccgccctgaagatgttggcaccagcctctactttgtaaatgactccttgcagcaggtgaccttttccagctccgtgggggtggtggtgccctgcccggccgcgggctcccccagcgcggcccttcgatggtacctggccacaggggacgacatctacgacgtgccgcacatccggcacgtccacgccaacgggacgctgcagctctaccccttctccccctccgccttcaatagctttatccacgacaatgactacttctgcaccgcggagaacgctgccggcaagatccggagccccaacatccgcgtcaaagcagttttcagggaaccctacaccgtccgggtggaggatcaaaggtcaatgcgtggcaacgtggccgtcttcaagtgcctcatcccctcttcagtgcaggaatatgttagcgttgtatcttgggagaaagacacagtctccatcatcccagaacacaggttttttattacctaccacggcgggctgtacatctctgacgtacagaaggaggacgccctctccacctatcgctgcatcaccaagcacaagtatagcggggagacccggcagagcaatggggcacgcctctctgtgacagaccctgctgagtcgatccccaccatcctggatggcttccactcccaggaagtgtgggccggccacaccgtggagctgccctgcaccgcctcgggctaccctatccccgccatccgctggctcaaggatggccggcccctcccggctgacagccgctggaccaagcgcatcacagggctgaccatcagcgacttgcggaccgaggacagcggcacctacatttgtgaggtcaccaacaccttcggttcggcagaggccacaggcatcctcatggtcattgatccccttcatgtgaccctgacaccaaagaagctgaagaccggcattggcagcacggtcatcctctcctgtgccctgacgggctccccagagttcaccatccgctggtatcgcaacacggagctggtgctgcctgacgaggccatctccatccgcgggctcagcaacgagacgctgctcatcacctcggcccagaagagccattccggggcctaccagtgcttcgctacccgcaaggcccagaccgcccaggactttgccatcattgcacttgaggatggcacgccccgcatcgtctcgtccttcagcgagaaggtggtcaaccccggggagcagttctcactgatgtgtgcggccaagggcgccccgccccccacggtcacctgggccctcgacgatgagcccatcgtgcgggatggcagccaccgcaccaaccagtacaccatgtcggacggcaccaccatcagccacatgaacgtcacaggcccccagatccgcgacgggggcgtgtaccggtgcacagcgcggaacttggtgggcagtgctgaatatcaggcgcgaataaacgtaagaggcccacccagcatccgggctatgcggaacatcacagcagtcgccgggcgggacacccttatcaactgcagggtcatcggctatccctactactccatcaagtggtacaaggatgccctgctgctgccagacaaccaccgccaggtggtgtttgagaatgggaccctcaagctgactgacgtgcagaagggcatggatgagggggagtacctgtgcagtgtcctcatccagccccagctctccatcagccagagcgttcacgtagccgtcaaagtgccccctctgatccagcccttcgaattcccacccgcctccatcggccagctgctctacattccctgtgtggtgtcctcgggggacatgcccatccgtatcacctggaggaaggacggacaggtgatcatctcaggctcgggcgtgaccatcgagagcaaggaattcatgagctccctgcagatctctagcgtctccctcaagcacaacggcaactatacatgcatcgccagcaacgcagccgccaccgtgagccgggagcgccagctcatcgtgcgtgtgccccctcgatttgtggtgcaacccaacaaccaggatggcatctacggcaaagctggtgtgctcaactgctcggtggacggctaccccccacccaaggtcatgtggaagcatgccaaggggagcgggaacccccagcagtaccaccctgtgcccctcactggccgcatccagatcctgcccaacagctcgctgctgatccgccacgtcctagaagaggacatcggctactacctctgccaggccagcaacggcgtaggcaccgacatcagcaagtccatgttcctcacagtcaagatcccggccatgatcacttcccaccccaacaccaccatcgccatcaagggccatgcgaaggagctaaactgcacggcacggggtgagcggcccatcatcatccgctgggagaagggggacacagtcatcgaccctgaccgcgtcatgcggtatgccatcgccaccaaggacaacggcgacgaggtcgtctccacactgaagctcaagcccgctgaccgtggggactctgtgttcttcagctgccatgccatcaactcgtatggggaggaccggggcttgatccaactcactgtgcaagagccccccgaccccccagagctggagatccgggaggtgaaggcccggagcatgaacctgcgctggacccagcgattcgacgggaacagcatcatcacgggcttcgacattgaatacaagaacaaatcagattcctgggacttcaagcagtccacacgcaacatctcccccaccatcaaccaggccaacattgtggacttgcacccggcatctgtgtacagcatccgcatgtactctttcaacaagattggccgcagtgaaccaagcaaggagctcaccatcagcactgaggaggccgctcccgatgggccccccatggatgttaccttgcagccagtgacctcacagagcatccaggtgacctggaaggcacccaagaaggagctgcagaacggtgtcatccggggctaccagattggctacagagagaacagccccggcagcaacgggcagtacagcatcgtggagatgaaggccacgggggacagcgaggtctacaccctggacaacctcaagaagttcgcccagtatggggtggtggtccaagccttcaatcgggctggcacggggccctcttccagcgagatcaatgccaccactctggaggatgtgcccagccagccccctgagaacgtccgggccctgtccatcacttctgacgtggccgtcatctcctggtcagagcccccgcgcagcaccctcaatggcgtcctcaaaggctatcgggtcatcttctggtccctctatgttgatggggagtggggcgagatgcagaacatcaccaccacgcgggagcgggtggagctgcggggcatggagaagttcaccaactacagcgtccaggtgctggcctacacccaggctggggacggcgtacgcagcagtgtgctctacatccagaccaaggaggacgttccaggtccccctgctggcatcaaagctgtcccttcatcagctagcagtgtggttgtgtcttggctcccccctaccaagcccaacggggtgatccgcaagtacaccatcttctgttccagccccgggtctggccagccggctcccagcgagtacgagacgagtccagagcagctcttctaccggatcgcccacctaaaccgcggtcagcagtatctgctgtgggtggccgccgtcacctctgccggccggggcaacagcagcgagaaggtgaccatcgagcctgctggcaaggccccagcaaagatcatctcctttgggggcaccgtgacaacaccttggatgaaagatgttcggctgccttgcaattcagtgggagatccagcccctgctgtgaagtggaccaaggacagtgaagactcggccattccagtgtccatggatgggcaccggctcatccacaccaatggcacactgctgctgcgtgcagtgaaggctgaggactctggctactacacgtgcacggccaccaacactggtggctttgacaccatcatcgtcaaccttctggtgcaagttcccccggaccagccccgcctcactgtctccaaaacctcagcttcgtccatcaccctgacctggattccaggtgacaatgggggcagctccatccgaggcttcgtgctacagtactcggtggacaacagcgaggagtggaaggatgtgttcatcagctccagcgagcgctccttcaagctggacagcctcaagtgtggcacgtggtacaaggtgaagctggcagccaagaacagcgtgggctctgggcgcatcagcgagatcatcgaggccaagacccacgggcgggagccctccttcagcaaagaccaacacctcttcacccacatcaactccacgcatgctcggcttaacctgcagggctggaacaatgggggctgccctatcacagccatcgttctggagtaccggcccaaggggacctgggcctggcagggcctccgggccaacagctccggggaggtgtttctgacggaactgcgagaggccacgtggtacgagctgcgcatgagggcttgcaacagtgcgggctgcggcaatgaaacagcccagttcgccaccctggactacgatggcagcaccattccacccatcaagtctgctcaaggtgaaggggatgatgtgaagaagctgttcaccatcggctgccctgtcatcctggccacactgggggtggcactgctcttcatcgtacgcaagaagaggaaggagaaacggctgaagcgactccgagatgcaaagagtttggcagaaatgttgataagcaagaacaatagaagctttgacacccctgtgaaagggccaccccagggcccacggctacacattgacatccccagggtccagctgctcatcgaggacaaagaaggcatcaagcaactgggagatgacaaggccaccatccctgtgacagatgctgagttcagccaagctgtcaacccacagagcttctgtactggcgtctccttgcaccacccaaccctcatccagagcacaggacccctcatcgacatgtctgacatccggccaggaaccaatccagtgtccaggaagaatgtgaagtcagcccacagcacccggaaccggtactcaagccagtggaccctgaccaagtgccaggcctccacacctgcccgcaccctcacctccgactggcgcaccgtgggctcccagcatggtgtcacggtcactgagagtgacagctacagtgccagcctgtcccaggacacagacaaaggaaggaacagcatggtgtccactgagagtgcctcttccacctacgaggagctggcccgggcctatgagcatgccaagctggaggagcagctgcagcacgccaagtttgagatcaccgagtgcttcatctctgacagttcctctgaccagatgaccacaggcaccaacgagaacgccgacagcatgacatccatgagcacaccctcagagcctggcatctgccgctttaccgcctcaccacccaagccccaggatgcggaccggggcaaaaacgtggctgtgcccatccctcaccgggccaacaagagtgactactgcaacctgcccctgtatgccaagtcagaggccttctttcgaaaggcagatggacgtgagccctgccccgtggtcccaccccgtgaggcctccatccggaacctggctcgaacctaccacacccaggctcgccacctgaccctggaccctgccagcaagtccttgggccttccccacccaggggcccccgctgccgcctccacagccaccttacctcagaggactctggccatgccagcccccccagccggcacagcccccccagcccccggccccacccctgctgagccacccaccgcccccagcgctgcccctccggcccccagcaccgagcctccacgagccgggggcccacacaccaaaatggggggctccagggactcgcttctcgagatgagcacatcgggggtagggaggtctcagaagcagggggccggggcctactccaaatcctacaccctggtgtagggcccgcaggaagagcagccacgcctggaccgcgccgcgccgcagccccacacgccagctcggctgtttttctgcattatttatattcaactgacagacaaaaaccaaccaacgacaaaacaaaaacccccaatcatgaacgcctgtacatagaactcttttgtacaaatgaaactattttcttcttctccatgaagccagggcacaaagaatttgacagtacaagtcaaatcccccaccccacaaaatatgtgtggagatatatatacatatatagacagacaggaacgcgtccacgagctatatatctatatatttctctcaccctattttgagacagaggcacaaagactcagcaatttttttccctcctcctcaccttccccccagtctaggtggttttgacaaagaccaaaatcccaactcagagacactgcatgcgattttactgttccaagaaaaccaggagttgcttcaatttgcagatgcttatgtgttaatacctttttctatgaaaaaagacccagcgccgtgtgcaataaaggttatgtttct

SEQ ID NO: 128005 - DNA, 6099 bp, Homo sapiens
  Payload ID: 5067
  Gene Symbol: DSCAML1
  Gene Name: Down syndrome cell adhesion molecule like 1
  ENST ID: ENST00000527706
  CDS Start-End: 13-5544
cctctttatggcatgtggctggtaactttcctcctgctcctggactctttacacaaagcccgccctgaagatgttggcaccagcctctactttgtaaatgactccttgcagcagctgccctgcaccgcctcgggctaccctatccccgccatccgctggctcaaggatggccggcccctcccggctgacagccgctggaccaagcgcatcacagggctgaccatcagcgacttgcggaccgaggacagcggcacctacatttgtgaggtcaccaacaccttcggttcggcagaggccacaggcatcctcatggtcattgatccccttcatgtgaccctgacaccaaagaagctgaagaccggcattggcagcacggtcatcctctcctgtgccctgacgggctccccagagttcaccatccgctggtatcgcaacacggagctggtgctgcctgacgaggccatctccatccgcgggctcagcaacgagacgctgctcatcacctcggcccagaagagccattccggggcctaccagtgcttcgctacccgcaaggcccagaccgcccaggactttgccatcattgcacttgaggatggcacgccccgcatcgtctcgtccttcagcgagaaggtggtcaaccccggggagcagttctcactgatgtgtgcggccaagggcgccccgccccccacggtcacctgggccctcgacgatgagcccatcgtgcgggatggcagccaccgcaccaaccagtacaccatgtcggacggcaccaccatcagccacatgaacgtcacaggcccccagatccgcgacgggggcgtgtaccggtgcacagcgcggaacttggtgggcagtgctgaatatcaggcgcgaataaacgtaagaggcccacccagcatccgggctatgcggaacatcacagcagtcgccgggcgggacacccttatcaactgcagggtcatcggctatccctactactccatcaagtggtacaaggatgccctgctgctgccagacaaccaccgccaggtggtgtttgagaatgggaccctcaagctgactgacgtgcagaagggcatggatgagggggagtacctgtgcagtgtcctcatccagccccagctctccatcagccagagcgttcacgtagccgtcaaagtgccccctctgatccagcccttcgaattcccacccgcctccatcggccagctgctctacattccctgtgtggtgtcctcgggggacatgcccatccgtatcacctggaggaaggacggacaggtgatcatctcaggctcgggcgtgaccatcgagagcaaggaattcatgagctccctgcagatctctagcgtctccctcaagcacaacggcaactatacatgcatcgccagcaacgcagccgccaccgtgagccgggagcgccagctcatcgtgcgtgtgccccctcgatttgtggtgcaacccaacaaccaggatggcatctacggcaaagctggtgtgctcaactgctcggtggacggctaccccccacccaaggtcatgtggaagcatgccaaggggagcgggaacccccagcagtaccaccctgtgcccctcactggccgcatccagatcctgcccaacagctcgctgctgatccgccacgtcctagaagaggacatcggctactacctctgccaggccagcaacggcgtaggcaccgacatcagcaagtccatgttcctcacagtcaagatcccggccatgatcacttcccaccccaacaccaccatcgccatcaagggccatgcgaaggagctaaactgcacggcacggggtgagcggcccatcatcatccgctgggagaagggggacacagtcatcgaccctgaccgcgtcatgcggtatgccatcgccaccaaggacaacggcgacgaggtcgtctccacactgaagctcaagcccgctgaccgtggggactctgtgttcttcagctgccatgccatcaactcgtatggggaggaccggggcttgatccaactcactgtgcaagagccccccgaccccccagagctggagatccgggaggtgaaggcccggagcatgaacctgcgctggacccagcgattcgacgggaacagcatcatcacgggcttcgacattgaatacaagaacaaatcagattcctgggacttcaagcagtccacacgcaacatctcccccaccatcaaccaggccaacattgtggacttgcacccggcatctgtgtacagcatccgcatgtactctttcaacaagattggccgcagtgaaccaagcaaggagctcaccatcagcactgaggaggccgctcccgatgggccccccatggatgttaccttgcagccagtgacctcacagagcatccaggtgacctggaaggcacccaagaaggagctgcagaacggtgtcatccggggctaccagattggctacagagagaacagccccggcagcaacgggcagtacagcatcgtggagatgaaggccacgggggacagcgaggtctacaccctggacaacctcaagaagttcgcccagtatggggtggtggtccaagccttcaatcgggctggcacggggccctcttccagcgagatcaatgccaccactctggaggatgtgcccagccagccccctgagaacgtccgggccctgtccatcacttctgacgtggccgtcatctcctggtcagagcccccgcgcagcaccctcaatggcgtcctcaaaggctatcgggtcatcttctggtccctctatgttgatggggagtggggcgagatgcagaacatcaccaccacgcgggagcgggtggagctgcggggcatggagaagttcaccaactacagcgtccaggtgctggcctacacccaggctggggacggcgtacgcagcagtgtgctctacatccagaccaaggaggacgttccaggtccccctgctggcatcaaagctgtcccttcatcagctagcagtgtggttgtgtcttggctcccccctaccaagcccaacggggtgatccgcaagtacaccatcttctgttccagccccgggtctggccagccggctcccagcgagtacgagacgagtccagagcagctcttctaccggatcgcccacctaaaccgcggtcagcagtatctgctgtgggtggccgccgtcacctctgccggccggggcaacagcagcgagaaggtgaccatcgagcctgctggcaaggccccagcaaagatcatctcctttgggggcaccgtgacaacaccttggatgaaagatgttcggctgccttgcaattcagtgggagatccagcccctgctgtgaagtggaccaaggacagtgaagactcggccattccagtgtccatggatgggcaccggctcatccacaccaatggcacactgctgctgcgtgcagtgaaggctgaggactctggctactacacgtgcacggccaccaacactggtggctttgacaccatcatcgtcaaccttctggtgcaagttcccccggaccagccccgcctcactgtctccaaaacctcagcttcgtccatcaccctgacctggattccaggtgacaatgggggcagctccatccgaggcttcgtgctacagtactcggtggacaacagcgaggagtggaaggatgtgttcatcagctccagcgagcgctccttcaagctggacagcctcaagtgtggcacgtggtacaaggtgaagctggcagccaagaacagcgtgggctctgggcgcatcagcgagatcatcgaggccaagacccacgggcgggagccctccttcagcaaagaccaacacctcttcacccacatcaactccacgcatgctcggcttaacctgcagggctggaacaatgggggctgccctatcacagccatcgttctggagtaccggcccaaggggacctgggcctggcagggcctccgggccaacagctccggggaggtgtttctgacggaactgcgagaggccacgtggtacgagctgcgcatgagggcttgcaacagtgcgggctgcggcaatgaaacagcccagttcgccaccctggactacgatggcagcaccattccacccatcaagtctgctcaaggtgaaggggatgatgtgaagaagctgttcaccatcggctgccctgtcatcctggccacactgggggtggcactgctcttcatcgtacgcaagaagaggaaggagaaacggctgaagcgactccgagatgcaaagagtttggcagaaatgttgataagcaagaacaatagaagctttgacacccctgtgaaagggccaccccagggcccacggctacacattgacatccccagggtccagctgctcatcgaggacaaagaaggcatcaagcaactgggagatgacaaggccaccatccctgtgacagatgctgagttcagccaagctgtcaacccacagagcttctgtactggcgtctccttgcaccacccaaccctcatccagagcacaggacccctcatcgacatgtctgacatccggccaggaaccaatccagtgtccaggaagaatgtgaagtcagcccacagcacccggaaccggtactcaagccagtggaccctgaccaagtgccaggcctccacacctgcccgcaccctcacctccgactggcgcaccgtgggctcccagcatggtgtcacggtcactgagagtgacagctacagtgccagcctgtcccaggacacagacaaaggaaggaacagcatggtgtccactgagagtgcctcttccacctacgaggagctggcccgggcctatgagcatgccaagctggaggagcagctgcagcacgccaagtttgagatcaccgagtgcttcatctctgacagttcctctgaccagatgaccacaggcaccaacgagaacgccgacagcatgacatccatgagcacaccctcagagcctggcatctgccgctttaccgcctcaccacccaagccccaggatgcggaccggggcaaaaacgtggctgtgcccatccctcaccgggccaacaagagtgactactgcaacctgcccctgtatgccaagtcagaggccttctttcgaaaggcagatggacgtgagccctgccccgtggtcccaccccgtgaggcctccatccggaacctggctcgaacctaccacacccaggctcgccacctgaccctggaccctgccagcaagtccttgggccttccccacccaggggcccccgctgccgcctccacagccaccttacctcagaggactctggccatgccagcccccccagccggcacagcccccccagcccccggccccacccctgctgagccacccaccgcccccagcgctgcccctccggcccccagcaccgagcctccacgagccgggggcccacacaccaaaatggggggctccagggactcgcttctcgagatgagcacatcgggggtagggaggtctcagaagcagggggccggggcctactccaaatcctacaccctggtgtagggcccgcaggaagagcagccacgcctggaccgcgccgcgccgcagccccacacgccagctcggctgtttttctgcattatttatattcaactgacagacaaaaaccaaccaacgacaaaacaaaaacccccaatcatgaacgcctgtacatagaactcttttgtacaaatgaaactattttcttcttctccatgaagccagggcacaaagaatttgacagtacaagtcaaatcccccaccccacaaaatatgtgtggagatatatatacatatatagacagacaggaacgcgtccacgagctatatatctatatatttctctcaccctattttgagacagaggcacaaagactcagcaatttttttccctcctcctcaccttccccccagtctaggtggttttgacaaagaccaaaatcccaactcagagacactgcatgcgattttactgttccaagaaaaccaggagttgcttcaatttgcagatgcttatgtgttaatacctttttctatgaaaaaagacccagcgccgtgtgcaataaaggttatgtttct

SEQ ID NO: 128006 - DNA, 583 bp, Homo sapiens
  Payload ID: 5067
  Gene Symbol: DSCAML1
  Gene Name: Down syndrome cell adhesion molecule like 1
  ENST ID: ENST00000525836
  CDS Start-End: 386-583
aaagaggctttgcctcagtagctcttctcaaccccagctgccgtgagtctgattcaactgatggggcatcggtggttgttcagcctccccaggtgaactcgaagtggagcaaaaggtgacagtcacagcttagtagcccgccctgaagatgttggcaccagcctctactttgtaaatgactccttgcagcaggtgaccttttccagctccgtgggggtggtggtgccctgcccggccgcgggctcccccagcgcggcccttcgatggtacctggccacaggggacgacatctacgacgtgccgcacatccggcacgtccacgccaacgggacgctgcagctctaccccttctccccctccgccttcaatagctttatccacgacaatgactacttctgcaccgcggagaacgctgccggcaagatccggagccccaacatccgcgtcaaagcagttttcagggaaccctacaccgtccgggtggaggatcaaaggtcaatgcgtggcaacgtggccgtcttcaagtgcctcatcccctcttcagtgcaggaatatgttagcgttgtatcttgggagaaagaca

SEQ ID NO: 128007 - DNA, 3256 bp, Homo sapiens
  Payload ID: 5068
  Gene Symbol: DSCR3
  Gene Name: Down syndrome critical region 3
  Uniprot ID: O14972
  ENST ID: ENST00000309117
  CDS Start-End: 239-1132
ggggtgaaccgtgacagcgcttcggcccgcactaaggccggctcttgtgccggaaggaggaaggcgtgggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccggggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcagtatacactgcgctgtgacatgaagcggtctctgttggccaaggacttgacaaagacctgtgaatttatcgttcactccgctcctcagaaggggaagtttactcccagtcccgtggacttcacgattacacctgaaaccttacagaacgtcaaagagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcgggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagcagtttgagcttgctggagagtggcatcatggggacaaaaggaaacctctgacttgctaatggatgtagccagggactccccatagcaaagggtctgtggccagttgacatccaggatggctgcaagcgcacttgatggtcaggaagtttgcagatactcgccaaggcagagcgcaaagtgctagccactggaaatgcatgacttccctccacccctactctattctgtagttttttggttttgtttctgagacggagtctcagtctgtcacccaggctggagtgatctcagctcactgcaacctccacctcccaggttcaagcgactctcctgcctcagcctcccgagtagttgggattacaggtgactgccaccgtgcccggctaatgtttgtatttttagtagagacggggcttcaccatcttggccaggctggtcttgaactcctgacctcgtgacccacccgccttggcctcccaaagtgctgggattacaggtgtgagccaccacacccagcctctgtagttctttttacaacatttttcattataactttaaattttttaagcaactggaaaagtgttccttgctctcttggggggatttggctggtgccgaagtgtttctgaagtctcaagaactgccataaaatctcacgctgccatttccctgaacagatacatacatagagagagacagttttccaaactgtgtcacgcaggctgagtgcactggcaggatcacagctcacggcagcctcaacctccctggctcaagcgatccctcccctcagcctcctgagtagctgagactacaggtgagtgccaccacactcagctaattttcaaattttttgtagacagggtctccctatgttgcccaggctggtcttgaactcctagactcaagtgatcctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttggcctaaagccagcatttcctcagtctccctttgtggttcgaaggatatggactattgcaatacatttcttccttcaaatcctgccactgttttgttggcccacaactaataggacctcaaaataagccatgctgctttgcacacacactagccttcttttgtacttttcattctggatgggcttggccaaaacaggctcaggccaaagacctcccaagctgtatgtacttccagtatcctgaaacagtgtttggtgacataatgccaagggtaaacaagcctgatttaggcactgctttatccaggggcttcacccatgaaattaataaaacttatctgagtcacttgaaacttggttcccagaaaacacatttctggtttataatctccttttatgctcacctgacattaattatctatccttgatgatgtgtttaaactgagtagcagaaaacagaggccacactttctgggaaattttaaaggaagaaaccatttttaatgagatgaaaatatttaacgaatttaaaaagctaatgacaattttgagaaaaggtttgggatgtatattgctatgtaatttaataaactgattttatggatataaata

SEQ ID NO: 128008 - DNA, 988 bp, Homo sapiens
  Payload ID: 5068
  Gene Symbol: DSCR3
  Gene Name: Down syndrome critical region 3
  ENST ID: ENST00000398998
  CDS Start-End: 239-988
ggggtgaaccgtgacagcgcttcggcccgcactaaggccggctcttgtgccggaaggaggaaggcgtgggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccgggcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcagtatacactgcgctgtgacatgaagcggtctctgttggccaaggacttgacaaagacctgtgaatttatcgttcactccgctcctcagaaggggaagtttactcccagtcccgtggacttcacgattacacctgaaaccttacagaacgtcaaagagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcgggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatag

SEQ ID NO: 128009 - DNA, 821 bp, Homo sapiens
  Payload ID: 5068
  Gene Symbol: DSCR3
  Gene Name: Down syndrome critical region 3
  ENST ID: ENST00000399001
  CDS Start-End: 58-576
cttgtttccctggggtcacgcgcagccggaagtggcggctgctgcggagaattggagatggggaccgccctggacatcaagattaaaagagcgaataaagtttatcacgccgggcctcagaaggggaagtttactcccagtcccgtggacttcacgattacacctgaaaccttacagaacgtcaaagagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcgggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaaga

SEQ ID NO: 128010 - DNA, 937 bp, Homo sapiens
  Payload ID: 5068
  Gene Symbol: DSCR3
  Gene Name: Down syndrome critical region 3
  Uniprot ID: O14972
  ENST ID: ENST00000476950
  CDS Start-End: 53-865
ttccctggggtcacgcgcagccggaagtggcggctgctgcggagaattggagatggggaccgccctggacatcaagattaaaagagcgaataaagtttatcacgccggggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcagcctcagaaggggaagtttactcccagtcccgtggacttcacgattacacctgaaaccttacagaacgtcaaagagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcgggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaagggg

SEQ ID NO: 128011 - DNA, 1098 bp, Homo sapiens
  Payload ID: 5069
  Gene Symbol: DSCR4
  Gene Name: Down syndrome critical region 4
  Uniprot ID: P56555
  ENST ID: ENST00000328264
  CDS Start-End: 106-462
cagtcacgggccagcctttcccttaaggatgtctgagagctggtctcctcactcttttcttccgcctattaaactttccgcttcttaactcacccatgtgtgtccatgtcgttaatcatcttgacgagagatgatgaaccccggatatttaccccagacagtgatgccgcttcaccagcattgcactctacttccccgcttcctgatcctgcctcagcttctcctctccacagagaagaaaaaattctgcctaaagtctgcaacatcgtttcctgcctgagtttcagcctgccagcttctcctacggattctggacttgccagccccacaatcataaccagagaggggcagcaattttgggcaaaatgtctgatttggaaataccaactttacctccatgggctccacaagaaatcagatgggagaagggacaagcagataagcgcaagcccatcaacctgaaggcataaaccacatccagccacctccttctgatcagcagcaaagctgacgttttgatctccatctgtctgattcttgtgtctacttctcagtttacaactccagtgggaaagaaagagctttatttacagacccataaaaatcccatcagtgtcgtcccctgctgagaggccatgtgagaccatatggaaaaacaacagccataatggcagcatggcagtggaagggtttgtcttgtgcccaggccttgcggtcatgcaagtttcttgtggatcctgttgggaccagccactcaccaaggctgagtaggtccacaaataatggggactttctaccagactcacagagaactgctgggtttttgggaagggtgtgcgtgtctttggggcatgcaagttggggttatagtggagacccagaggatgagaaaacttctctgcctcagcagaagagtggcagctgagagagaggcaagaaactcgcacccactgtggactggggcagagagattttgaggagaatgaaatccagaaactctgtgtggtattagtttgtatccagagggtgaccctcttctcaaggaaatgggtgtcatcaattttctacactattaaagatataaagttcttggcatta

SEQ ID NO: 128012 - DNA, 777 bp, Homo sapiens
  Payload ID: 5069
  Gene Symbol: DSCR4
  Gene Name: Down syndrome critical region 4
  ENST ID: ENST00000398948
  CDS Start-End: 85-468
cttaaggatgtctgagagctggtctcctcactcttttcttccgcctattaaactttccgcttcttaactcacccatgtgtgtccatgtcgttaatcatcttgacgagagatgatgaaccccggatatttaccccagacagtgatgccgcttcaccagcattgcactctacttccccgcttcctgatcctgcctcagcttctcctctccacagagaagaaaaaattctgcctaaagtctgcaacatcgtttcctgcctgagtttcagcctgccagcttctcctacggattctggacttgccagccccacaatcatcagggatcctgtggcctccaaatcccagttggaactcagctcaaggccagcaaaaacagagcctagagcctggagcgcacagtttggcaggtgcagtgcgcagccccaaccccaagtggattttctacctgcagagaatacctgctctgggtgaccacagctgctgagaaatcttcccagaagaggcaggatgggatggaatgctgggattacagatgaactttcctggccaccctggataagcagaacctgaataaagtaaatcatgatcacaccccaaggcaagacagaggcctctggcatgtaagaaggctccccagtggtcaagacagaagcaggcttcaagaaatggaaagtattggtgggcagagtggggtcagtgagggatgagggtgcaggagcactcagagaagcacacaaggtgtccttctgagctggatgcttgtgataactggagagggaa

SEQ ID NO: 128013 - DNA, 799 bp, Homo sapiens
  Payload ID: 5069
  Gene Symbol: DSCR4
  Gene Name: Down syndrome critical region 4
  ENST ID: ENST00000482032
  CDS Start-End: 77-316
tgtctgagagctggtctcctcactcttttcttccgcctattaaactttccgcttcttaactcacccatgtgtgtccatgtcgttaatcatcttgacgagagatgatgaaccccggatatttaccccagacagtgatgccgcttcaccagcattgcactctacttccccgcttcctgatcctgcctcagcttctcctctccacagagaagaaaaaattctgcctaaagtctgcaacatcgtttcctgcctgagtttcagcctgccagcttctcctacggattctggacttgccagccccacaatcataagctggtgaaggctctcaggtaaaggaaatgacttgggacatctggctcctgttctgacataagtgaagatcaaacaaggtcacatgtttatgaggaagcaccttttaattgctgcattctctaaatatgaagagttacaatgattaacgaattgcatccttgtcacccctccaagcacattgagataagctttctcaacaaggagaatcttgagatgtagtttgaatcacaaggcattacctaatggatataaaattggatagtgtttttggcttagatgggagcagatctgacgtttccaaggaaatgtatacacatgcaccttccattttacataaatttcaggaaattcaagacctccagaagctcagtcatcactctctgaggagatcaacttcatgagccttctctacctgagagaggactacaaatactgttttattccatgatcaatcagctgagtgtagaaagaaatatattacctcttcctc

SEQ ID NO: 128014 - DNA, 552 bp, Homo sapiens
  Payload ID: 5070
  Gene Symbol: DSCR8
  Gene Name: Down syndrome critical region 8
  Uniprot ID: Q96T75
  ENST ID: ENST00000357704
  CDS Start-End: 150-443
accccaccctaatcttgttatgcaaataggcttcccacttggcaggggccgtcttgtccactcgtttctgtaaacatgggtggcaaaaagagaagatggagctgccatttagaacatgcctaatcccagcttcatcttgctgagcaaaaatgaaggagcctggacccaactttgttactgtgagaaagggtcttcattcattcaagatggcatttgttaagcacctacttctctttctgtcacctaggctggagtgcagtggttcaatcacggatcactgcagcctccacctcccagttcaagaaattctcatgtctcagcctcctgagcagctaggattacagacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctca

SEQ ID NO: 128015 - DNA, 534 bp, Homo sapiens
  Payload ID: 5070
  Gene Symbol: DSCR8
  Gene Name: Down syndrome critical region 8
  Uniprot ID: Q96T75
  ENST ID: ENST00000400477
  CDS Start-End: 150-425
accccaccctaatcttgttatgcaaataggcttcccacttggcaggggccgtcttgtccactcgtttctgtaaacatgggtggcaaaaagagaagatggagctgccatttagaacatgcctaatcccagcttcatcttgctgagcaaaaatgaaggagcctggacccaactttgttactgtgagaaagggtcttcattcattcaagatggcatttgttaagcacctactgctggagtgcagtggttcaatcacggatcactgcagcctccacctcccagttcaagaaattctcatgtctcagcctcctgagcagctaggattacagacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctca

SEQ ID NO: 128016 - DNA, 403 bp, Homo sapiens
  Payload ID: 5070
  Gene Symbol: DSCR8
  Gene Name: Down syndrome critical region 8
  Uniprot ID: Q96T75
  ENST ID: ENST00000614538
  CDS Start-End: 1-294
atgaaggagcctggacccaactttgttactgtgagaaagggtcttcattcattcaagatggcatttgttaagcacctacttctctttctgtcacctaggctggagtgcagtggttcaatcacggatcactgcagcctccacctcccagttcaagaaattctcatgtctcagcctcctgagcagctaggattacagacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctca

SEQ ID NO: 128017 - DNA, 1647 bp, Homo sapiens
  Payload ID: 5071
  Gene Symbol: DR1
  Gene Name: down-regulator of transcription 1
  Uniprot ID: Q01658
  ENST ID: ENST00000370267
  CDS Start-End: 588-1118
aaaccttccctggcatctggagggaccaccgttgccgcgtcttcggcttccacgatctgcgttcgggctacgcggccacggcggcagccactgcgactcccactgtgcctggctctgtccatattagttcccaggcggccgtcgccgttccagcagcggcagcggcagcggcagcggcggacatgttgtgaggcggcggcgcgggtgtctgaaggatggtttggccgaggcggcggcaacggctgctggcggcggcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctccgttcattttctgcaccctcttcgcaaagcaccccccgggatcactctccgagggcgactttttgagaaatctcggtggagtagtggaccagagctggggagtttttaaaagccggggcgcgagaaacaggaaggtactatggcttcctcgtctggcaacgatgatgatctcactatccccagagctgctatcaataaaatgatcaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcatacaagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaagctctaaatctgcatttgcatttcctctgcccttttaactaaactaaaacttgtgaattttaaattattaaggggggggtgctgtgtgaatcagtagacattggattgggttggtgaaagagttcagttctgtagtatctgaatttgtcttttaaaatgagtacatatataggcaataaatatatatgctcagatc

SEQ ID NO: 128018 - DNA, 10148 bp, Homo sapiens
  Payload ID: 5071
  Gene Symbol: DR1
  Gene Name: down-regulator of transcription 1
  Uniprot ID: Q01658
  ENST ID: ENST00000370272
  CDS Start-End: 759-1289
gaacgaggcttccggtggcgcaaagggtgtcgggagcggcttcctgcaaaccttccctggcatctggagggaccaccgttgccgcgtcttcggcttccacgatctgcgttcgggctacgcggccacggcggcagccactgcgactcccactgtgcctggctctgtccatattagttcccaggcggccgtcgccgttccagcagcggcagcggcagcggcagcggcggacatgttgtgaggcggcggcgcgggtgtctgaaggatggtttggccgaggcggcggcaacggctgctggcggcggcggcagcggcagcggggcctcgggctctatagagccgagcccgctgggtacccgcccggtaccgcggcgaggccagtgcccctggatcttgcctctgctccgacgccgttggggaccagttaggcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctccgttcattttctgcaccctcttcgcaaagcaccccccgggatcactctccgagggcgactttttgagaaatctcggtggagtagtggaccagagctggggagtttttaaaagccggggcgcgagaaacaggaaggtactatggcttcctcgtctggcaacgatgatgatctcactatccccagagctgctatcaataaaatgatcaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcatacaagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaagctctaaatctgcatttgcatttcctctgcccttttaactaaactaaaacttgtgaattttaaattattaaggggggggtgctgtgtgaatcagtagacattggattgggttggtgaaagagttcagttctgtagtatctgaatttgtcttttaaaatgagtacatatataggcaataaatatatatgctcagatcaatatacttgtttagaaaaacttcaagacattcaaaaactaggaaggagtatgtttaatagtatttgtataaatttggtggttatgtttttttattttgtttctgttttgtgtagaggtaaaaactatagttttattacagcataattcattttgagctccactatgacatttcaaagactgcccagtttggaagtctgtcatgatttttactctttcactccaattcagtaattgttgatagtattacttacctagtccatccatactcatattattcaaatatataggtggtacttttgaaacaattacattggttctcttggtttaactgaggtttatgaatattcaaacctttgctgggggaaagaaatgaaagttaatgagcatgcttgctatgagagagggatttttaatttaacttgtagttatagtttacttattgtttttagaattacttttacattttcccaactagatggcctagagtccaacattaccttttgagatgacattattgtctccataattgagtgatagctttaaaaaaaagattagttttgcttaagaagttatgttacaactgatcagccctatatgaattaactgatcagccctatatgaaacataagttgtgttataacttatcagccgtatatggaacataaatagtttctacctgcttgttagagaagctttaatttggttctaataaatacagtatggtagtgtttataggaatccaggatgttgaagaaatggcataatgtctatattttggaaacagaaaggaaaagtcacttaagatagtattaagtaattaaattcctatgtcagttgccaaatcttttaaacttatgtattcaccaagcccaaaaatagattgtggctcccaggattccaattttaattggagagctaagtaagtaaagttttataactgttaggtttcttaatgatcatattttgcagttttagtaaaagggaaatattgttatacatttattaaatatacttcccccatgaagtgaaaaggttaattttgctgaatgttttaagttgaagttacttcatggatgtcatacccatgaagtgcatttggatgagatagaagaaattgttttttaaaaagtttaagtaccaaaggtagtctagtctagaacgataagttaatacgtgttggcttttctaatttgtactgtaacatccttatactttctattttaagtatatctgtttcttaagtaaacaacttagatattttccacacctttttttttttttctgatgcagagttcaggttaatattttactgcatctgataatgtattatacgtttgaagcctagtgacttttcattttgacattcttgtgatttcatatgctgtattcttcaagcaataaaattgtgatgtgttttataaatggtttttatatttaatgttctatagagagatttctattattaccatttttactattttcaagaatcttaggcccaaaagacattttggtcatttggtatgtagtacctgccttttgtttttgtttactgttatttcaaaaaatgtggttttacttgtatttttataatttacagtcctaagatcgaggcataacaaagcttacttatgcaatattttatttttaggttttttcttttttttttttttttttttttttttttagcatttaagagtcactattatgttttgccagttaaaattttttaaatcttttgaagagagaaacaaaatcttcagcgttcttgagaaataaaattattgttcagtaagtatttttccatccccttgaatatatgttatatattctttttcggcagattatcagattagtaagtgtttaaaaggcatcagtttttaaaactgcatataccacacacacacaaaacagtacacaaataaaggttttcacaaattaaacaaactcacatactagtcttcagatcaaaacacagagcattatgtgtaccccagaagccctcctctttccccatcttaacactgtcttctttcttgctgaaagttactatcctgacttctaaaatcatagattagttttgcctgttttttattttatgtaaatgtaatcatacataatacactttttttcattcatcatttttgtgaatattttagtttcttgttgccactgtaacaaactaccacaaacttagtgacttaaaacaacacagatttattcttttatagtcctggagatcagaagtccaaaaatcagtttcattaggcctaaatcaaagtatcagcagggttggctctttattgaggttgtgagggagaatgttttcttcccttttttggcttccagtgacggcctgtatttatgggcttgtgaccccttcctctctatgatcaaagcttgcttttgtcattatatcatcttctcttctgtagtcagatctttccctgcctctaagtttagggctcacctgcataaagcagggataatccccctatctcaagatccttaatttaatcacatctgcagaatctcttttgccatataagtgacattcacaggttccagggattcatacgctggctatctttggaggccgttattcaacctgccaaagtgagatccattcttattgttgcatgtatttgtagttcattcattctcattgctgtatagtcttccgtttgtttatccatttttcattacatccaaaagttattcattctcccattaatagtcttttgagaatttttcaattctgagctattatgaatagtactgtgtagaacattcttatacatgtcttttggtgagtgtatacatttccattgagtataaacctaagaatggaattgccaggttgtagggtgtgtatattttcagttttagtatttactgtcaaacagttttccaaagtgactgtaagaaggcaccattttaatgtgtagcataaaaatgaattacgctaatgatcttagtgggttgaatttctcgaaacacctaaattgtaccaaatgagttatattgcagcaggtatgttgttaatttcatataacaggaaaataagagcaaaagtaattgcccttattaactgacacattagtattacatactcattaggttattgctccttagaaaaaatgcaaattttaagtaatcgtaagtagtatgttgaattagtatgttgtgggaaaatctgtgatttaattttttaattgaattttaaattttgggttataacctcattaaaatgcatgatatttccttatataggtttctaaattatgtctgtccaactcatctatatccaaatggccattaggaagaattatccaattcagatggcataggcactgccttccaatttcttcatttgtatttttttgttgctgttttcttttttgcctctgtccccaacaatttgaccacaagtcctaccccacctcctctgtttttcaccatcccccaggatataaagtgtcatggttaggatcggccagggtgaagagaatgataacataagtagcctcctttcacctaaagtattaccactggttcttatcctatttcctcaaaataaatgagaagagaaagtaaggaataagaggaagaaactttttttttttttttaaagaaacagggtctcactatgtttcctttttcttttttcttttcttttctttcttttttttttttttttttttgagacagagtcttgctctgtcacccaggctggaatgcagtggcgcgatctcggctcactgcaagctccgcctcccgggttcacgccattctcctgcctcagcctcctgagtagctgggactacaggtgcccgctagcacgcccagctaattttttttgtttttttttagtagagacagggtttcaccgtgttagccaggatggtctcgatctcctgacctcgtgatccacccgccttggcctcccaaagtgctgggattacaggcgtgagccactgcgcccggcctatgtttcttaatatagattgcagtggctagattacagtgactattcacaggcataatcataatgcaccatagcctcaaactcctgggctcaagcaatccaaaaggaggaaacttttaacttatgatcagtttctaccataaatcaagcaacttagaaaaaccttagaacagggtttctcaaaccaagcattgttagtatttggggttggttaagtctttgtttgtgggagcctatcctgtgcattgtaggatttctagcagcataattggcttatgcccacttgatgtcattagcaccactccccaccctacttccagttgtgacaacccaaaaatgtctccagacatagccaactgtccctgggtgttgcgagtataggaggcaaaattgcaccctgttgaaaaccaccaccttagatcatctaggttttacttttaggataagacacttgagggaaaggctgtgaaactgaacctctgttagaagcaacacacagtatcactgcaaaaagactaaaagaaataggtgatttggaaagaggaggcccaggattaaaatatgtttccaagaaagtcaaatcttacaggagactcttgacttcacatctgctgatccctttacccgataggacctagagcagccattataaatctctgtacctgcttgctgcttttctacctcattgttagccacacccagtttgaaacagatgaggtatgctatttcataactagtacatcttttaataagcattttttattgtgattaaatatgcatatcgtaaaattcaccactttaaccagttttaagtgttcaattctgtggcattaagtatattcatactattgtgcaaccaccaccaccatccgtctacagaactcttcatcttcccaaactgaaattatgtattcattaaacaataaccacccattacctcctctctcctcagcctctggtaaccagcattcagtctctatgaattgactactctggatatctaaatggattcattcttatttcatttaccataatgtcttcaaagttcattcatgttgtagcatgtattagaatttctttcctcttaaaggccaaatatgccgtagtatgtaaataccgtattttgtttatcagttcatccattaatggacactgggttgcttctgctttttggctattgtgaataatgcttctgtgaacgtgggtatacaaataactgtttgagtcctaataggcttgttatttttgagtgcacagatctgtatattcgcaattgaaatagggaaagtctttatattcatataaagataatttataatacaataagtcctcaatgttgttgataggttctgggaaactgcgagtttaagaaaaacaacatataatgaaatcaattttaccataggtgaactgatataaataagagttaagtccctatggcatatatttctggttacaaaaacactaccaaatttctaataaagacccaaaacacttctaaaattaaacattgagattaatatgagctttatatacatttaaaaaggataaaaacaagtaagaattggctggacatggtggcttacgcctgtaatctcaacactgggaagtcgaggtgggcagatggcttgacctcaggagttcggaaccagcctgggtaatatggtgaaacccgtctctacagaaaaattcaaaaattagccagaggtggtggcttgcacctgtagtcccagctactcgggagcctgatgtgggaggatcccttgagcctgggaggtcgaggctgcagtgagccatgatcacgctactgcactccagtctgggcaacagagcaaaatcctatctcaaaaaaaatatatatattatccagccccaaatgtttatggggttgttattgataaaccctgcattaaacaatcccacagtcggtgctgcggtgagccgtgatggtaccactgcattccagcctgggtgacagaatgagaccctgtctcaaaaaaaaaaaaaaaaagtaaaaattatttacccaatatttggcgaatcagtgagtgacagcagttgtagtgctagtgggttaaatcaaggaataactgttgggaagtgaaaattttaaggagcacctcctaccaccatgcagttcaaaaacaaaaaataagaaataaagtgggcttgctgagtgctttcatactgcatcatttattgtgcatttgtatgattattatatactttacaaattttcgttttacagtaatttgtattcattcgtttttcaacctgcttatttcagttcagtgtcttgggtagctggagcctatcccagcagctcagggagcaaagtgggagccaaccctggacaggatgccttttcatcacagggcgcactcacacggcacacacacgcatactgggaccatttagctgtaccaattcacctaacgtgcatctttgggaattgagaagaaaccagaatacccagagaaaactcatgcagatatgtggaggacatgcaaaattcacacagacagtggccctggttgtaaataattgtttttcatcaatgttataatgaaattacaggccgggtgtggtggcttacgcctgtaatcccagcactttgggaggccgaggcgggtggatcacgaggtcaggagatagagaccatcccggccaacatagtgaaacctcatctgtgctaaaatacaaaaaattagccaggcttggtggtgtgcacctgtagtcccagctacttgggaggctgaggcaggggatttcttgaacccagaaggcggaggttgcagtgagttgagatcgcgacactgcactccagcctgacaacagagcaagacttcgtctcaaaaaaacaaacaaaaaaagaaattacattagttgaggacctgctgtatgtgatatgaacaatgaggatcaactctttttgtaatagtttttttacatatgttatttcatttgtttatttcctctgtgagggtaagtattgatagtccagtcatagactggtaacacaggcacaccattaaaaataatagacatacagtatgcagtattttgttttacttatgaaactccgtattttatgtatgatgtattgagtatgaagaatagtacatactgtttccttttaactttatgtttcttgcctttgtatattttatatgaatagcacttgtcactaacatagaaagcagtagaggtggaagagggagacttgccagaataagtttttaatgtgaatcagagatttttattaggaattgggagtggaaggagagagatagtattagaaagtatgtatgcagcaaaggatggagaaactgtccttgttgttaaggcatctaaggatgctccaattactggggaaaacataccaggctcaaaatggtctgattatgcaaataccttctaatacgtttgtttcttttgttgtgcctataaaagatgccattaacttcatatttatgtcactaataaacttctagaatccatgtagtagggtgtagtagtgtggttaagctatgaagaacaatggtatttatttccaaaacacttatttggtatattacataggatagagtatgttttctaagccaaatagtgttaggttttcatgtgcagttgccttacacatatactagtagcccttacaaaatttcgtctgtctttattataaacatgttgtaagtgaggaaactaagattccaagaaattaagtactgttggccctctgtgtctgggggttccacatctatagatcgaccaaccatggactgatggattgaaaacatttggggaaaaaacaaaaaataacccaacaatgaaatagtataaattttaaaaataatataacaatatttatatatcatttacattatgttagatattataatctagagatgattagcatccttggattttggattttggtatccttggggtatcctggaaccaatccctggcggataccaagggatgactgtaatataataacatctaacaagtgaaggatttgaaccccaatgtaagtaattatgaaaactatttttcttccactagaacttttttccccaaaaatactctggaaatactggaacaaatactaaaataaatgacctttatttgaagatcttttaaaaaaattataagcctgcctgaggatagcaaaattgtgtgcttttgcaaggtaattgtagaactcattctaaggaagcagaggtaatgtctgttactattttcagctccctttttctgtccactgttgtctaaatgattcactcagtgttatgcagaatatgagaagttattttataaagttgatttgtggtataggc

SEQ ID NO: 128019 - DNA, 2028 bp, Homo sapiens
  Payload ID: 5072
  Gene Symbol: DONSON
  Gene Name: downstream neighbor of SON
  ENST ID: ENST00000303113
  CDS Start-End: 30-1688
cggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacagagccttatctattggctccaccctgctttgtcttggctaccactgttccctcgtattggagctgatagaaaaatggctggaaagacaagtccttggtcaaatgatgcaaccctgcagcatgttttaatgagtgactggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaaatctccatcaaagcagacacaggatgtttgcctgcaggggggagaaatacccagttttaaattatttccaccaacttctgcaacaaataatgaattcaaggtgggattagggtaagaggaaattcaaaaacgtgctctcacctgacagatctttcattgcagcagagaagttcccagacctcttttgtgctctttctcctactgcaacaagacctttaaaaaaaaattgttcactaaataaatttcaaagcaccactttaaaacaaagatccctctgtaggagtctgaacctcaaaatgtatgccttcaaataaaatcagcagattcctagt

SEQ ID NO: 128020 - DNA, 2170 bp, Homo sapiens
  Payload ID: 5072
  Gene Symbol: DONSON
  Gene Name: downstream neighbor of SON
  Uniprot ID: Q9NYP3
  ENST ID: ENST00000303071
  CDS Start-End: 68-1768
aggggcgggcccggcgcgcgcgggaagtctctgtagggcggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatcta

SEQ ID NO: 128021 - DNA, 1820 bp, Homo sapiens
  Payload ID: 5072
  Gene Symbol: DONSON
  Gene Name: downstream neighbor of SON
  ENST ID: ENST00000417871
  CDS Start-End: 30-440
cggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatac

SEQ ID NO: 128022 - DNA, 1180 bp, Homo sapiens
  Payload ID: 5072
  Gene Symbol: DONSON
  Gene Name: downstream neighbor of SON
  ENST ID: ENST00000444517
  CDS Start-End: 1-477
tttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttg

SEQ ID NO: 128023 - DNA, 2332 bp, Homo sapiens
  Payload ID: 5072
  Gene Symbol: DONSON
  Gene Name: downstream neighbor of SON
  ENST ID: ENST00000453626
  CDS Start-End: 6-1532
gcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatctactgagctagttgattggtgatgcttctaccttaatatctttcctactgatttataattcctttattttcacatatactaaaactttttaaatgcatgttaattcagataaaaaggcattttgtattccacatagaatagtgttaagaattgtgaagtacactgagctgtcacggcaaagtagtatttaatgtgcttataggggtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtagggggggactgtataattcacatttttaaaataaaagtgcttaaaaatcaaaagcattgggtaaagaa

SEQ ID NO: 128024 - DNA, 1618 bp, Homo sapiens
  Payload ID: 5072
  Gene Symbol: DONSON
  Gene Name: downstream neighbor of SON
  ENST ID: ENST00000432378
  CDS Start-End: 66-1553
gggcgggcccggcgcgcgcgggaagtctctgtagggcggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagatt

SEQ ID NO: 128025 - DNA, 1719 bp, Homo sapiens
  Payload ID: 5072
  Gene Symbol: DONSON
  Gene Name: downstream neighbor of SON
  ENST ID: ENST00000437395
  CDS Start-End: 1-1613
tttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataa

SEQ ID NO: 128026 - DNA, 703 bp, Homo sapiens
  Payload ID: 5072
  Gene Symbol: DONSON
  Gene Name: downstream neighbor of SON
  ENST ID: ENST00000440810
  CDS Start-End: 1-703
gcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactgggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctgga

SEQ ID NO: 128027 - DNA, 1566 bp, Homo sapiens
  Payload ID: 5072
  Gene Symbol: DONSON
  Gene Name: downstream neighbor of SON
  ENST ID: ENST00000442660
  CDS Start-End: 1-471
tttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttg

SEQ ID NO: 128028 - DNA, 2273 bp, Homo sapiens
  Payload ID: 5072
  Gene Symbol: DONSON
  Gene Name: downstream neighbor of SON
  ENST ID: ENST00000457359
  CDS Start-End: 6-638
gcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatctactgagctagttgattggtgatgcttctaccttaatatctttcctactgatttataattcctttattttcacatatactaaaactttttaaatgcatgttaattcagataaaaaggcattttgtattccacatagaatagtgttaagaattgtgaagtacactgagctgtcacggcaaagtagtatttaatgtgcttataggggtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtagggggggactgtataattcacatttttaaaataaaagtgctta

SEQ ID NO: 128029 - DNA, 528 bp, Homo sapiens
  Payload ID: 5072
  Gene Symbol: DONSON
  Gene Name: downstream neighbor of SON
  ENST ID: ENST00000439593
  CDS Start-End: 1-57
aaatcatctttacggaatgtggtgctgagagactacatttataattggagatcctgaacaccaaacccatttttctcatcaaaacggctcccattcctccagttaccggggctgctcttaagaactgatcctatccaaagaaagaaaggatttatttgtagaattggaggtgtttactggaagatgatgatatggccaagccaaggaagggaacctacagtgaagagtacaggtgtctctgatctacatatccaagaactgcaagaaaaatgtccagatgggcatcagatacctagtccagtccttggcaaaagtctgggctttggaaaccaagggcaagaggcgatgacaactaatctatagaacccattctccataaacactatccgcttcttttttccgatgttgagatccagatgatacagggaattcttttgttaatgttacctggctttttggtggagttggttttgctgcagcaatctaaaaaataaagtgtttcttaattaaagctcaatatgatatcta

SEQ ID NO: 128030 - DNA, 2472 bp, Homo sapiens
  Payload ID: 5073
  Gene Symbol: DPH2
  Gene Name: DPH2 homolog
  Uniprot ID: Q9BQC3
  ENST ID: ENST00000255108
  CDS Start-End: 173-1642
agaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagttgccttgcagttccctgaccagctattgggagatgctgtggctgtggctgcacgactggaggagacgacagggtcaaagatgttcattctgggtgacacagcctacggcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagcgttggtctatactgactcttatttctcagggagatcacagcaacctaaataaaccagataccttttc

SEQ ID NO: 128031 - DNA, 1738 bp, Homo sapiens
  Payload ID: 5073
  Gene Symbol: DPH2
  Gene Name: DPH2 homolog
  Uniprot ID: Q9BQC3
  ENST ID: ENST00000396758
  CDS Start-End: 152-937
tgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagttgccttgcagttccctgaccagctattgggagatgctgtggctgtggctgcacgactggaggagacgacagggtcaaagatgttcattctgggtgacacagcctacggcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctgggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagcgttggtctatactgactcttatttctcagggagatcac

SEQ ID NO: 128032 - DNA, 502 bp, Homo sapiens
  Payload ID: 5073
  Gene Symbol: DPH2
  Gene Name: DPH2 homolog
  ENST ID: ENST00000532140
  CDS Start-End: 110-268
ctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgttgccttgcagttccctgaccagctattgggagatgctgtggctgtggctgcacgactggaggagacgacagggtcaaagatgttcattctgggtgacacagcctacggcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctg

SEQ ID NO: 128033 - DNA, 2414 bp, Homo sapiens
  Payload ID: 5073
  Gene Symbol: DPH2
  Gene Name: DPH2 homolog
  ENST ID: ENST00000495421
  CDS Start-End: 167-448
agtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgttgccttgcagttccctgaccagctattgggagatgctgtggctgtggctgcacgactggaggagacgacagggtcaaagatgttcattctgggtgacacagcctacggcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagcgttggtctatactgactcttatttctcagggagatcacagcaacctaaataaaccagataccttttc

SEQ ID NO: 128034 - DNA, 1013 bp, Homo sapiens
  Payload ID: 5073
  Gene Symbol: DPH2
  Gene Name: DPH2 homolog
  ENST ID: ENST00000459879
  CDS Start-End: 1-789
gcctttgaggcccagaacccagaccccaaagcgcctgtggtgctgctgagtgagccggcctgtgcccatgccctggatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaa

SEQ ID NO: 128035 - DNA, 851 bp, Homo sapiens
  Payload ID: 5073
  Gene Symbol: DPH2
  Gene Name: DPH2 homolog
  ENST ID: ENST00000492306
  CDS Start-End: 154-456
gctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagttgccttgcagttccctgaccagctattgggagatgctgtggctgtggctgcacgactggaggagacgacagggtcaaagatgttcattctgggtgacacagcctacggcagtgatgacagcaactcgcctccagaagagaacccatttctctgatgctatcttccctgcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaaga

SEQ ID NO: 128036 - DNA, 1596 bp, Homo sapiens
  Payload ID: 5073
  Gene Symbol: DPH2
  Gene Name: DPH2 homolog
  ENST ID: ENST00000524776
  CDS Start-End: 169-612
acagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagttgccttgcagttccctgaccagctattgggagatgctgtggctgtggctgcacgactggaggagacgacagggtcaaagatgttcattctgggtgacacagcctacggcagaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctca

SEQ ID NO: 128037 - DNA, 643 bp, Homo sapiens
  Payload ID: 5073
  Gene Symbol: DPH2
  Gene Name: DPH2 homolog
  ENST ID: ENST00000527319
  CDS Start-End: 1-106
gagtccagagcctatgcccctagagcgttttgggcgccgcttcccccttgccccagggaggcgtctagaagagctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcct

SEQ ID NO: 128038 - DNA, 857 bp, Homo sapiens
  Payload ID: 5073
  Gene Symbol: DPH2
  Gene Name: DPH2 homolog
  ENST ID: ENST00000476260
  CDS Start-End: 177-485
gcggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgttgccttgcagttccctgaccagctattgggagatgctgtggctgtggctgcacgactggaggagacgacagggtcaaagatgttcattctgggtgacacagcctacggcaggtgtgaacttggccttaggtgggccaggcctggggatccggggctcatggggttttacgtctatgacagtgattgccttcaatggtggtgtttctccttgatgataatgctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccaggg

SEQ ID NO: 128039 - DNA, 3768 bp, Homo sapiens; identical to SEQ ID NO: 126995
  Payload ID: 5074
  Gene Symbol:
  Gene Name: DPP6
  ENST ID: ENST00000634466
  CDS Start-End: 386-2797

SEQ ID NO: 128040 - DNA, 1109 bp, Homo sapiens; identical to SEQ ID NO: 127000
  Payload ID: 5074
  Gene Symbol:
  Gene Name: DPP6
  ENST ID: ENST00000634249
  CDS Start-End: 234-1109

SEQ ID NO: 128041 - DNA, 3710 bp, Homo sapiens; identical to SEQ ID NO: 126996
  Payload ID: 5074
  Gene Symbol:
  Gene Name: DPP6
  ENST ID: ENST00000634541
  CDS Start-End: 142-2739

SEQ ID NO: 128042 - DNA, 4798 bp, Homo sapiens; identical to SEQ ID NO: 126998
  Payload ID: 5074
  Gene Symbol:
  Gene Name: DPP6
  ENST ID: ENST00000635128
  CDS Start-End: 588-2993

SEQ ID NO: 128043 - DNA, 2012 bp, Homo sapiens; identical to SEQ ID NO: 126997
  Payload ID: 5074
  Gene Symbol:
  Gene Name: DPP6
  ENST ID: ENST00000634875
  CDS Start-End: 404-1465

SEQ ID NO: 128044 - DNA, 2388 bp, Homo sapiens; identical to SEQ ID NO: 126999
  Payload ID: 5074
  Gene Symbol:
  Gene Name: DPP6
  ENST ID: ENST00000634779
  CDS Start-End: 54-2330

SEQ ID NO: 128045 - DNA, 4870 bp, Homo sapiens
  Payload ID: 5075
  Gene Symbol: DPY19L1
  Gene Name: dpy-19-like 1 (C. elegans)
  Uniprot ID: Q2PZI1
  ENST ID: ENST00000310974
  CDS Start-End: 146-2173
ccctaagtggccgctccgggcgccttctccctgccccgccgcgtctcgcctgcgcgggctccaagcgcagccttaacaggctccgaaacttgaatcagcgccccgatcccgagagggctcttccttcggccccatcactcccacaatggaagggcggccgcctccggaaggccgtccgcccccgcgtcctcgcaccggccgagccccgcgcgggcgccgaagagctgtttttgcagcagtgttgcactggagccatataacacacctctttgaaaatgaccgtcatttttctcacctctcaacattggaaagggagatggcttttcgcactgaaatgggactatattattcctatttcaagactattgtggaagcaccctcatttttgaatggagtatggatgattatgaatgataaactgactgaatacccccttgtcattaatacattaaaaagattcaatctttaccctgaggtaattttggccagttggtaccggatttataccaaaataatggacttgattggtattcaaaccaagatatgttggacggttaccagaggagaaggactcagtcctattgaaagctgtgaaggattgggagatcctgcttgcttttatgttgctgtaatttttattttaaatggactaatgatggcattattcttcatatatggcacatatttaagtggcagccgattaggaggcctggttacagtgttgtgcttctttttcaatcatggagagtgtacccgtgtaatgtggacaccacctctccgtgaaagcttctcatatccatttcttgttcttcagatgttgctagtgactcatattctcagggctacaaaactttatagaggaagcttgattgcactctgcatttccaatgtatttttcatgcttccttggcagtttgctcagtttgtacttcttactcagattgcatcattatttgcagtatatgttgtcgggtacattgatatatgtaaattacggaagatcatttatatacacatgatttctcttgcactttgttttgttttgatgtttgggaactcaatgttattaacttcttattatgcttcttctttggtaattatttggggtattctggcaatgaaaccacatttcctgaaaataaatgtatctgaacttagtttatgggttattcaaggatgtttttggttatttggaactgtcatacttaaatacttgacatctaaaatttttggtattgcagatgacgctcatattggcaacttactaacatcaaaattctttagttataaggattttgatactttattgtatacctgtgcagcggagtttgactttatggaaaaagagactccactgagatacacaaagacattattgcttccagttgttcttgtagtgtttgttgctattgttagaaagattattagtgatatgtggggtgtcttagctaaacaacagacacatgtaagaaaacaccagtttgatcatggagagctggtttaccatgcattgcaattgttagcatatacagcccttggtattttaattatgagactaaaactcttcttgacaccacacatgtgtgttatggcatcactgatctgctcaagacagctatttggatggctcttttgcaaagtacatcctggtgctattgtgtttgctatattagcagcaatgtcaatacaaggttcagcaaatctgcaaacccagtggaatattgtaggggagttcagcaatttgccccaagaagaacttatagaatggatcaaatatagtactaaaccagatgcagtgtttgcgggtgccatgcccacgatggcaagtgttaagctctctgcacttcggcccattgtgaatcatccacattatgaagacgcaggcttgagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctacctgtataaagaaaacacagtgggttgtgacaaggatgacatgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatatagaactatctgtttgttttacttccttgtgcgctttttgttctctgttctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagtttttatattttacttttaagattgcctgtctttaataagacaaagccttaagccttatgttataattttggttctaaaaaccatcatttcagtataaggaataagtatatttcgtcctcctctttagtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttgctttagtatgaggaaagtaaggatgggcaaagaagcgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtactatatatgttaaattaaaaaaaatcatgagtaatgagggaa

SEQ ID NO: 128046 - DNA, 619 bp, Homo sapiens
  Payload ID: 5075
  Gene Symbol: DPY19L1
  Gene Name: dpy-19-like 1 (C. elegans)
  ENST ID: ENST00000446375
  CDS Start-End: 1-619
tgtacccgtgtaatgtggacaccacctctccgtgaaagcttctcatatccatttcttgttcttcagatgttgctagtgactcatattctcagggctacaaaactttatagaggaagcttgattgcactctgcatttccaatgtatttttcatgcttccttggcagtttgctcagtttgtacttcttactcagattgcatcattatttgcagtatatgttgtcgggtacattgatatatgtaaattacggaagatcatttatatacacatgggtattctggcaatgaaaccacatttcctgaaaataaatgtatctgaacttagtttatgggttattcaaggatgtttttggttatttggaactgtcatacttaaatacttgacatctaaaatttttggtattgcagatgacgctcatattggcaacttactaacatcaaaattctttagttataaggattttgatactttattgtatacctgtgcagcggagtttgactttatggaaaaagagactccactgagatacacaaagacattattgcttccagttgttcttgtagtgtttgttgctattgttagaaagattattagtgatatgtggggtgtcttagctaaac

SEQ ID NO: 128047 - DNA, 255 bp, Homo sapiens
  Payload ID: 5075
  Gene Symbol: DPY19L1
  Gene Name: dpy-19-like 1 (C. elegans)
  ENST ID: ENST00000428054
  CDS Start-End: 1-250
gtttgcgggtgccatgcccacgatggcaagtgttaagctctctgcacttcggcccattgtgaatcatccacattatgaagacgcaggcttgaggcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgct

SEQ ID NO: 128048 - DNA, 607 bp, Homo sapiens
  Payload ID: 5075
  Gene Symbol: DPY19L1
  Gene Name: dpy-19-like 1 (C. elegans)
  Uniprot ID: Q2PZI1
  ENST ID: ENST00000612226
  CDS Start-End: 177-434
atgcaaacagacagtgagtggaggacaccagcaaagtaataaggaatgtttcaaaaggatatgatgaactgaggcttatcgagtcagggagcagaaagctgaaataagaccgctaagctctaaacaaatccgttaaagcttcacagggcagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctt

SEQ ID NO: 128049 - DNA, 4060 bp, Homo sapiens
  Payload ID: 5076
  Gene Symbol: DPY19L2
  Gene Name: dpy-19-like 2 (C. elegans)
  Uniprot ID: Q6NUT2
  ENST ID: ENST00000324472
  CDS Start-End: 185-2461
gcgaatggcttccaacgcatgcgccccaccccacatttcacagtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggagatggaaaagtcggccctaggcggcgggaaactgccaaggggctcctggaggtcctccccggggaggatccaaagtctgaaagagcgaaaaggcttggagctagaggtggtggccaagacctttcttctcggccccttccagttcgtccgtaattccctggcgcagctccgggaaaaggtgcaggaactgcaggcgcggcggttctccagcagaaccactctcggcatcgctgtctttgtggcaattttacattggttacatttagtaacactttttgaaaatgatcgtcatttctctcacctctcatctttggaacgggagatgacttttcgcactgaaatgggactttattattcatacttcaagaccattattgaagcaccttcgtttttggaaggactgtggatgattatgaatgacaggcttactgaatatcctcttataattaatgcaataaaacgcttccatctttatccagaggtaatcatagcctcctggtattgcacattcatgggaataatgaatttatttggactagaaactaagacctgctggaatgtcaccagaatagaacctcttaatgaagttcaaagctgtgaaggattgggagatcctgcttgcttttatgttggtgtaatctttattttaaatggactaatgatgggattgttcttcatgtatggagcatacctgagtgggactcaactgggaggtcttattacagtactgtgcttctttttcaaccatggagaggccacccgtgtgatgtggacaccacctctccgtgaaagtttttcctatcctttccttgtacttcagatgtgtattttaactttgattctcaggacctcaagcaatgatagaaggcccttcattgcactctgtctttccaatgttgcttttatgcttccctggcaatttgctcagtttatactttttacacagatagcatcattatttcccatgtatgttgtgggatacattgaaccaagcaaatttcagaagatcatttatatgaacatgatttcagttacccttagtttcattttgatgtttggaaattcaatgtacttatcttcttattattcttcatctttgttaatgacgtgggcaataattctaaagagaaatgaaattcaaaaactgggagtatctaaactcaacttttggctaattcaaggtagtgcctggtggtgtggaacaatcattttgaaatttctgacatctaaaatcttaggcgtttcagaccacattcgcctgagtgatcttatagcagccagaatcttaaggtatacagattttgatactttaatatatacctgtgctcccgaatttgacttcatggaaaaagcgactccgctgagatacacaaagacattattgcttccagttgttatggtgattacatgttttatctttaaaaagactgttcgtgatatttcatatgttttagctacaaacatttatctaagaaaacagctccttgaacacagtgagctggcttttcacacattgcagttgttagtgtttactgcccttgccattttaattatgaggctaaagatgtttttgacaccgcacatgtgtgttatggcttccttgatatgctctcgacagctctttggctggctttttcgcagagttcgttttgagaaggttatctttggcattttaacagtgatgtcaatacaaggttatgcaaacctccgtaatcaatggagcataataggagaatttaataatttgcctcaggaagaacttttacagtggatcaaatacagtaccacatcagatgctgtctttgcaggtgccatgcctacaatggcaagcatcaagctgtctacacttcatcccattgtgaatcatccacattacgaagatgcagacttgagggctcggacaaaaatagtttattctacatatagtcgaaaatctgccaaagaagtaagagataaattgttggagttacatgtgaattattatgttttagaagaggcatggtgtgttgtgagaactaagcctggttgcagtatgcttgaaatctgggatgtggaagacccttccaatgcagctaaccctcccttatgtagcgtcctgctcgaagacgccaggccttacttcaccacagtatttcagaatagtgtgtacagagtattaaaggttaactgagaaggatactacccattttactatggcacaatgccgtgtgtcaaaaacaatcaccctttggcttattcacattaataaaaatcacaagctttaataacagacacttaaaaataagataaaaatggattggaaatttttctgattactaaaaggtaaattacttttctgttcattgaatgtcagccttattaagcttgtcatataagttattaaatcattcatgtcatactgcataaacaaatgttcatttcagaattttaaagagaaatgtatataaaagaacaatgaattttaataaatcaggggtatgtaagtcctttttcatccaactaggtgaattgcttcagattttctctagtaccagagggtacctcctcaaactctttgaaccacttaaggcagaagaatgcaagctctgaaatgacatccttaaaatgctgatactggtcacagcctctttacctctgtgaggaaattgtaacagtgtgtcttttaaggtgtttttattttaccagcccttaagaaagatctctaataccttttaatacttttttttaataatttcaagttgaagtgtttttaaaaacactttgttttgtaatgttttgaatctcttgagatgtgtttaccccactagatacatatttgccactggttagttctccatctaagctcaagaggttattcatctctctttagattccagtggcttttcttttaacatccaggtaaaacagaaactgctatggtatacaaccaagttttggggttaaacataatcagaaaagaaaatccagttaaatttatgaagtgagattttcagatcctagatcttgaataaaggaaaggtcttttcatcttgatggccccaaagcttgttggtcatggtctttatttctggccactatcttcttaaataatatatttttaagccctcatttatttttggttttgggtgaggaaagtcatgttttctaagtcctctcccctaataaaacctacccaacaatagtgctttgaaaagtggtagttatcttgaagatactcttgccaaatgcaaagataaacattctttttgtctgctttataaatatgaaatatgccagatctatagtattttaatgtgcatctactttaaatgagtcatcttggggtttttataattcccttatgttcttgcccctctacacttgaaataacaaaatgccttaattttatggattagttctcttatagtagacaggcagctatatgcagcaaaaccaataaagttatttttcaactttcatagttgtaaaatatcttataacagaatacaaaacagctaagaaaacatgccacattttattttagcattttcaaataatttgtttttggtgtaagcacaggataaaaaaggagagcgtcaaagaaaagagacataacacctaacattcataaaaattaacaaagtatattttggatgatgtttttacaggaaatattttaaataagttggtagaacttttaaaatggtactgtattagctaataaaatattcagtacaaatatatgtttggatttatgcattaaaaaactaataaaattatttccaacttt

SEQ ID NO: 128050 - DNA, 1173 bp, Homo sapiens
  Payload ID: 5076
  Gene Symbol: DPY19L2
  Gene Name: dpy-19-like 2 (C. elegans)
  ENST ID: ENST00000439061
  CDS Start-End: 1-449
caataattctaaagagaaatgaaattcaaaaactgggagtatctaaactcaacttttggctaattcaaggtagtgcctggtggtgtggaacaatcattttgaaatttctgacatctaaaatcttaggcgtttcagaccacattcgcctgagtgatcttatagcagccagaatcttaaggtatacagattttgatactttaatatatacctgtgctcccgaatttgacttcatggaaaaagcgactccgctgagatacacaaagacattattgcttccagttgttatggtgattacatgttttatctttaaaaagactgttcgtgatatttcatatgttttagctacaaacatttatctaagacagatggagcacagggaaatgtgtcttggcattctaaaaaagaatgaatggagaaccctggacactgttcccataaggagtacatgaagggacttgggatatttaattggataatagaagattgaaggaaaacagctccttgaacacagtgagctggcttttcacacattgcagttgttagtgtttactgcccttgccattttaattatgaggctaaagatgtttttgacaccgcacatgtgtgttatggcttccttgatatgctctcgacagatgctgtctttgcaggtgccatgcctacaatggcaagcatcaagctgtctacacttcatcccattgtgaatcatccacattacgaagatgcagacttgagggctcggacaaaaatagtttattctacatatagtcgaaaatctgccaaagaagtaagagataaattgttggagttacatgtgaattattatgttttagaagaggcatggtgtgttgtgagaactaagcctggttgcagtatgcttgaaatctgggatgtggaagacccttccaatgcagctaaccctcccttatgtagcgtcctgctcgaagacgccaggccttacttcaccacagtatttcagaatagtgtgtacagagtattaaaggttaactgagaaggatactacccattttactatggcacaatgccgtgtgtcaaaaacaatcaccctttggcttattcacattaataaaaatcacaagctttaataacagacacttaaaaataagataaaaatggattggaaatttttctgattactaaaaggtaaattac

SEQ ID NO: 128051 - DNA, 491 bp, Homo sapiens
  Payload ID: 5076
  Gene Symbol: DPY19L2
  Gene Name: dpy-19-like 2 (C. elegans)
  ENST ID: ENST00000538147
  CDS Start-End: 350-491
gtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgagaaaacaaggaaggaattgaaaacaagcagttccccaaccaaacgggcacaggctgcgtttgcagctcctgtaaaagctccatacccagagcagtgtctcctagctcccagctgtctttgtggcaattttacattggttacatttagtaacactttttgaaaatgatcgtcatttctctcacctctcatctttggaacgggagatgacttttcgcactgaaatgggactttattattcatacttcaagaccattattgaagcaccttcgtttttggaaggactgtggatgattatgaatgacaggcttactgaatatcctcttataattaatgcaataaaacgct

SEQ ID NO: 128052 - DNA, 603 bp, Homo sapiens
  Payload ID: 5076
  Gene Symbol: DPY19L2
  Gene Name: dpy-19-like 2 (C. elegans)
  ENST ID: ENST00000541083
  CDS Start-End: 230-603
aactacataactagtaacaagaaactgaactggggaagcagagagtaaatggagaattttgatgacatttcatgatactaagattttccatcagagctccttcctacataacaaatgctgatgataataataatattctatattggaagtgagaaattctgccaagaagtctcatgctgccaatagcctacaaagaatgaaattataaccccagctcaattggtgctgcatgtttaaagtattccgtctgtttaacttcataaaagttggcccctttcagatagcatcattatttcccatgtatgttgtgggatacattgaaccaagcaaatttcagaagatcatttatatgaacatgatttcagttacccttagtttcattttgatgtttggaaattcaatgtacttatcttcttattattcttcatctttgttaatgacgtgggcaataattctaaagagaaatgaaattcaaaaactgggagtatctaaactcaacttttggctaattcaaggtagtgcctggtggtgtggaacaatcattttgaaatttctgacatctaaaatcttaggcgtttcagaccacattcgcctgagtgatct

SEQ ID NO: 128053 - DNA, 505 bp, Homo sapiens
  Payload ID: 5076
  Gene Symbol: DPY19L2
  Gene Name: dpy-19-like 2 (C. elegans)
  ENST ID: ENST00000542209
  CDS Start-End: 234-505
cccaatgaagcgcgtgaagggcaagcggtgatgggttctgcgccagtggggctgggagcccgtccggggctgtacatggggctgcgcgcaagtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggagatggaaaagtcggccctaggcggcgggaaactgccaaggggctcctggaggtcctccccggggaggatccaaagtctgaaagagcgaaaaggcttggagctagaggtggtggccaagacctttcttctcggccccttccagttcgtccgtaattccctggcgca

SEQ ID NO: 128054 - DNA, 1549 bp, Homo sapiens
  Payload ID: 5076
  Gene Symbol: DPY19L2
  Gene Name: dpy-19-like 2 (C. elegans)
  ENST ID: ENST00000306389
  CDS Start-End: 150-578
tttcacagtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggagatggaaaagtcggccctaggcggcgggaaactgccaaggggctcctggaggtcctccccggggaggatccaaagtctgaaagagcgaaaaggcttggagctagaggtggtggccaagacctttcttctcggccccttccagttcgtccgtaattccctggcgcagctccgggaaaaggtgcaggaactgcaggcgcggcggttctccagcagaaccactctcggcatcgctgtctttgtggcaattttacattgggactttattattcatacttcaagaccattattgaagcaccttcgtttttggaaggactgtggatgattatgaatgacaggcttactgaatatcctcttataattaatgcaataaaacgcttccatctttatccagaggtaatcatagcctcctggtattgcacattcatgggaataatgaatttatttggactagaaactaagacctgctggaatgtcaccagaatagaacctcttaatgaagttcaaagctgtgaaggattgggagatcctgcttgcttttatgttggtgtaatctttattttaaatggactaatgatgggattgttcttcatgtatggagcatacctgagtgggactcaactgggaggtcttattacagtactgtgcttctttttcaaccatggagaggacctcaagcaatgatagaaggcccttcattgcactctgtctttccaatgttgcttttatgcttccctggcaatttgctcagtttatactttttacacagatagcatcattatttcccatgtatgttgtgggatacattgaaccaagcaaatttcagaagatcatttatatgaacatgatttcagttacccttagtttcattttgatgtttggaaattcaatgtacttatcttcttattattcttcatctttgttaatgacgtgggcaataattctaaagagaaatgaaattcaaaaactgggagtatctaaactcaacttttggctaattcaaggtagtgcctggtggtgtggaacaatcattttgaaatttctgacatctaaaatcttaggcgtttcagaccacattcgcctgagtgatcttatagcagccagaatcttaaggtatacagattttgatactttaatatatacctgtgctcccgaatttgacttcatggaaaaagcgactccgctgagatacacaaagacattattgcttccagttgttatggtgattacatgttttatctttaaaaagactgttcgtgatatttcatatgttttagctacaaacatttatctaag

SEQ ID NO: 128055 - DNA, 6015 bp, Homo sapiens
  Payload ID: 5077
  Gene Symbol: DPY19L3
  Gene Name: dpy-19-like 3 (C. elegans)
  Uniprot ID: Q6ZPD9
  ENST ID: ENST00000342179
  CDS Start-End: 216-2366
aagtttgcggagcggcttctgctcgtcggccgtgcggcgaggcagggcctgggctgcgaccccggcggccgctcgcggtcttgggagagctggggcgcgtgcctgaacttcccggctgcccctgtccttggagacctacctgatggggacgccaggtgtgcaggggcgtggcgcgtaggagtgatttggagaacaatgcatgtaagtctgacatcatgatgtccatccggcaaagaagagaaataagagccacagaagtttctgaagactttccagcccaagaagaaaatgtgaagttggaaaataaattgccatctggttgtaccagtagaagattatggaagattttgtcattgacaattggtggaaccattgccctttgcattggacttcttacatctgtctaccttgccacgttacatgaaaatgatttatggttttctaatattaaggaagtggagcgagaaatctcattcagaacagagtgtggcctgtattactcctactacaagcagatgctgcaggctccaaccctcgtgcaaggttttcatggcctaatatatgataataaaactgaatctatgaagacaattaacctccttcagcgaatgaatatttaccaagaggtttttctcagtattttatatagagttctacccatacagaaatatttagagccagtttatttttatatttacaccttatttgggctccaggcgatctatgtcacagctctctacataaccagctggctactcagtggtacatggctgtcaggactgttggcagctttctggtatgtcacaaatagaatagataccacaagagttgagtttaccatcccactgagggagaactgggcgctgccattctttgcaattcagatagcagcaattacatatttcctgagaccaaacttacagcctctttctgaaaggctgacacttcttgccattttcatatcaacttttctctttagtctgacatggcaatttaatcaatttatgatgctgatgcaagcattagtgctgttcacactggactccctggacatgctgccagcagtgaaggcgacatggctgtatggaatacagataacaagtttactcctggtctgcattcttcagttttttaattccatgattcttggatcactgcttatcagttttaacctttcagtattcattgcaagaaaacttcagaaaaatctgaaaactggaagcttccttaataggcttgggaaacttttgttacatttatttatggttttatgtttgacactttttctcaacaacataattaagaaaattcttaacctgaagtcagatgaacacatatttaaatttctgaaggcaaaatttgggcttggagcaacaagggattttgatgcaaatctctatctgtgtgaagaagcttttggcctcctgccttttaatacatttggaaggctttcagatactctgcttttttatgcttacatattcgttctgtccatcacagtgattgtagcattcgttgttgcctttcataatctcagtgattctacaaatcaacaatccgtgggtaaaatggaaaaaggcacagttgacctgaaaccagaaactgcctacaacttaatacataccattctgtttggattcttggcattgagtacaatgagaatgaagtacctctggacgtcacacatgtgtgtgttcgcatcattcggcctatgtagccctgaaatatgggagttacttctgaagtcagtccatctttataacccaaagaggatatgtataatgcgatattcagtaccgatattaatactgctgtatctatgctataagttctggccaggaatgatggatgaactctccgagttgagagaattctatgatccagatacagtggagctgatgaactggattaactctaacactccaagaaaggctgtgtttgcgggaagcatgcagttgctggccggagtcaagctgtgcacgggaaggaccctaaccaaccacccgcactatgaagacagcagcctgagagagcggaccagagcggtttatcagatatatgccaagagggcaccagaggaagtgcatgccctcctaaggtccttcggcactgactacgtaatcctggaagacagcatctgctacgagcggaggcaccgccggggctgccgactccgggacctgctggacattgccaacggccacatgatggatggcccaggagagaatgatcctgatttgaaacctgcagaccaccctcgcttctgtgaagagatcaaaagaaacctgcctccctacgtggcctacttcaccagagtgttccagaacaaaaccttccacgtttacaagctgtccagaaacaagtagcgcagatttctgcccagtgtctatttttgatacggagaaactgcatcatgatgaaactcaatagatgacgtttcctatgtaagtaggtagcccaaaccttcaagctgtgatatgagtaagttctacagatgtttacacaagtgttgccatctttgaaagcatcttctacaagcagaagtctttttcgttgtgtgtctatctttctcattaatgttctttagcctaaatgttaacaactttctaagagtgacctagaattatgttgttggagagaatgatgtgtgttccatggatacctggataggcacataacatgttggaagatgagcacctgctcaggatttgaaatacgtttaattttcaggtgacttaagacagctatgattgaatcaactagagatgatgatcgacttatttaatatgatttcactggtgaagaccaattggtagctttttaaaaagcactttagtgtcctgttttaccttaaaatgttataatattttccagttgtcatgctgtcaacattaacaaaaaaaatcatgttaaggctttgtatcaaacattttgttacactctgtctgaaatgtaatgtggagtacttcagcagtatgtgtcatgtattgtgtgtgtctgtgtgtgtgcatgtgcacacatgtgttttaatgctgggcacagaaaagtgttacaagttccatatcgtaagtccttaaaggggcagaaatatatgtagccaagtagaatttattacattttagtgttattattttaaaacttactgatactctttaacctctcctgcagtaatagttttgctttatttcttactcatttcaatttattgggtttgcaaaattttgtaaactttttgtgtttttagcctttgtattttttacagcctagaatcttgcaaagtctgaatattttttaaatgttctatcttaactagttcactaatacagtatttttagcagacagcattttcagacagcattttcataccaagtttgacttgtggtctccaatcttactgggaaggccctggtagtgtaattcttttccttattaaaaggtaaccaagtgcctctaagtcatgcttatttgtaaacaacaaagaagagtatatgtacctgctcaaaatttttttgataatcgcttatataattaatttctaatgatgaggacatgtaaaagttgccagtaagaacatagtatgcatttaattaaatcaagatggctaatggaattaactttctcccctgttcttgccaggtggaaatgatttaagcatttctccttgcagttgtattgaagtaaattaccataggcatcaagatggctgcatcacattttcaaatgattttatattcagttgctacttataaagcagcattcaaaaagtcttttacactgtcatgttggacacaagcagactcagcttttatcaaaacttgtttaaataaaaaattgacagtagctgggttattaaattatgcaactgaaactcctgaattatatcttttctgtatcccttaataagattggagaccactgccgtttaggataatacaataataaaacgttttaatcagtactaaaactttaattaagccaataatgatgcatgcctgttgtagctgacagcatgggtcagtacatccttcagcgagtgccttactctaattgaaaccaagcacacgtaaggtacaatatgttagactctgtgattttgttttcaaaatcctctgttatggctatatttaaatttattttaaatattcctgtatgtattcatctaagcatttgggcatttggagtcttaatatacaagaaacacgtacttaaatttttatgcttatcaccgcaatgatggcaaacagtgattttttttttcatagtttaggtgtcattgttgccagcacctttagtgctcagtcttcagtgaaaaatataaagtgccaaaaaaatcttgcaagacagaatccatacttaacactctttccaagacactgtgaccatgtacagtagctatttcctgatgaccaaatctctcaacgaatcatgttattaataaatatttttagcactcatcagtattctccaatgtgaccttctcattggagtacacagaaggaaagcaaagaagagcatctgacttctagctctggcttacagcctctctaccaggccgaagcaagagacccgcggcagcagctccccgccactcagacctgggtggtgataacctcaaagaatggctctgttttctattgacagaaaacccacttgattttgcttctgagttagcagtcagaagaccctctaagtacaatagaagtgctcttaacggactctgcctgtgtgactcccaggccccggagtctccatctctctcgtaagccacctgccacagcacagctggaggctgttctctggtgttctcagcgctccggctccctccctggagttgtgcacccgtcccaaactcctccatgcaagttctgcttcctcttataagtacacaactcagttaagtattcacatacacacagaaaatacgggtgtgaaaagaaagaattttctgtaaaaattaagttgaatactttggtaaaaagtgataaaggctgagttgccaataaaagttgcttttaaattaggtgtggctgggaatattataagatattggggaaaatatacaaatcaagaaaatttctgagcttagattgcttcatagatttatttaagtactcatcccacctttaaaacctctaaactgagaagaagggacccaaatcatgttattggtgtgatttatgtgagaagtagaactgtagtcattggacccttaggcaaaggaaaatccgtgtctttatatcagaagatcggcaaacgaatgtatattacacagtttaggttatgattccctactttaacctacttactttattaaatgaccaactactgatactgatcacaatagttattagagattctaatttagttggaaggttctaatcactttcattacaggcatttgaaaaatagggattcatttcgaatatattagccaggagcatagttagatgttacccaggccatttatcatcctgttaatgatgattttcccgacccttgtgagatcagcgtgacaggagtgtgtgtgtgtgtgtgtgtttctgtgggtgtgtggttttggttgggtgctgccaggtggcaaaggcatatgtaaatacatctgatctgcatctttatttcacagttaactaaaagtaaaaatgtctattctgattccatattgattttgtctaagatgtaaaaatttgagttcatctttggccaaaacctacctgaattaacatacaaaatatttgatttttaaaatttaattcaaatctcaaaatcaattaagtattctcagatcctatatcttggttaatatgctcccagatactttaaacatggcaaccttttggcctaagagaatgtttgttcatggaaaaaagcttttgagatgagagggtgtcttactttcttgtggcaattgattttctgttttaacaccctttgggtaaaatcttgcaaagagcttttataatttgttttactgaattgtatggagattgtataccaagtaaagctcttttaaattac

SEQ ID NO: 128056 - DNA, 5998 bp, Homo sapiens
  Payload ID: 5077
  Gene Symbol: DPY19L3
  Gene Name: dpy-19-like 3 (C. elegans)
  Uniprot ID: Q6ZPD9
  ENST ID: ENST00000392250
  CDS Start-End: 199-2349
gttgacgccccccagcccctcatttccacaaagctccgcggcggttctgccctccttgtacccgcggcgcgctgcggcccgtggcgcggccccgttcccgcctagccccgtcggcctccttcccctcccggagccgcgcgtgaggacggctgaggccgcaggagtgatttggagaacaatgcatgtaagtctgacatcatgatgtccatccggcaaagaagagaaataagagccacagaagtttctgaagactttccagcccaagaagaaaatgtgaagttggaaaataaattgccatctggttgtaccagtagaagattatggaagattttgtcattgacaattggtggaaccattgccctttgcattggacttcttacatctgtctaccttgccacgttacatgaaaatgatttatggttttctaatattaaggaagtggagcgagaaatctcattcagaacagagtgtggcctgtattactcctactacaagcagatgctgcaggctccaaccctcgtgcaaggttttcatggcctaatatatgataataaaactgaatctatgaagacaattaacctccttcagcgaatgaatatttaccaagaggtttttctcagtattttatatagagttctacccatacagaaatatttagagccagtttatttttatatttacaccttatttgggctccaggcgatctatgtcacagctctctacataaccagctggctactcagtggtacatggctgtcaggactgttggcagctttctggtatgtcacaaatagaatagataccacaagagttgagtttaccatcccactgagggagaactgggcgctgccattctttgcaattcagatagcagcaattacatatttcctgagaccaaacttacagcctctttctgaaaggctgacacttcttgccattttcatatcaacttttctctttagtctgacatggcaatttaatcaatttatgatgctgatgcaagcattagtgctgttcacactggactccctggacatgctgccagcagtgaaggcgacatggctgtatggaatacagataacaagtttactcctggtctgcattcttcagttttttaattccatgattcttggatcactgcttatcagttttaacctttcagtattcattgcaagaaaacttcagaaaaatctgaaaactggaagcttccttaataggcttgggaaacttttgttacatttatttatggttttatgtttgacactttttctcaacaacataattaagaaaattcttaacctgaagtcagatgaacacatatttaaatttctgaaggcaaaatttgggcttggagcaacaagggattttgatgcaaatctctatctgtgtgaagaagcttttggcctcctgccttttaatacatttggaaggctttcagatactctgcttttttatgcttacatattcgttctgtccatcacagtgattgtagcattcgttgttgcctttcataatctcagtgattctacaaatcaacaatccgtgggtaaaatggaaaaaggcacagttgacctgaaaccagaaactgcctacaacttaatacataccattctgtttggattcttggcattgagtacaatgagaatgaagtacctctggacgtcacacatgtgtgtgttcgcatcattcggcctatgtagccctgaaatatgggagttacttctgaagtcagtccatctttataacccaaagaggatatgtataatgcgatattcagtaccgatattaatactgctgtatctatgctataagttctggccaggaatgatggatgaactctccgagttgagagaattctatgatccagatacagtggagctgatgaactggattaactctaacactccaagaaaggctgtgtttgcgggaagcatgcagttgctggccggagtcaagctgtgcacgggaaggaccctaaccaaccacccgcactatgaagacagcagcctgagagagcggaccagagcggtttatcagatatatgccaagagggcaccagaggaagtgcatgccctcctaaggtccttcggcactgactacgtaatcctggaagacagcatctgctacgagcggaggcaccgccggggctgccgactccgggacctgctggacattgccaacggccacatgatggatggcccaggagagaatgatcctgatttgaaacctgcagaccaccctcgcttctgtgaagagatcaaaagaaacctgcctccctacgtggcctacttcaccagagtgttccagaacaaaaccttccacgtttacaagctgtccagaaacaagtagcgcagatttctgcccagtgtctatttttgatacggagaaactgcatcatgatgaaactcaatagatgacgtttcctatgtaagtaggtagcccaaaccttcaagctgtgatatgagtaagttctacagatgtttacacaagtgttgccatctttgaaagcatcttctacaagcagaagtctttttcgttgtgtgtctatctttctcattaatgttctttagcctaaatgttaacaactttctaagagtgacctagaattatgttgttggagagaatgatgtgtgttccatggatacctggataggcacataacatgttggaagatgagcacctgctcaggatttgaaatacgtttaattttcaggtgacttaagacagctatgattgaatcaactagagatgatgatcgacttatttaatatgatttcactggtgaagaccaattggtagctttttaaaaagcactttagtgtcctgttttaccttaaaatgttataatattttccagttgtcatgctgtcaacattaacaaaaaaaatcatgttaaggctttgtatcaaacattttgttacactctgtctgaaatgtaatgtggagtacttcagcagtatgtgtcatgtattgtgtgtgtctgtgtgtgtgcatgtgcacacatgtgttttaatgctgggcacagaaaagtgttacaagttccatatcgtaagtccttaaaggggcagaaatatatgtagccaagtagaatttattacattttagtgttattattttaaaacttactgatactctttaacctctcctgcagtaatagttttgctttatttcttactcatttcaatttattgggtttgcaaaattttgtaaactttttgtgtttttagcctttgtattttttacagcctagaatcttgcaaagtctgaatattttttaaatgttctatcttaactagttcactaatacagtatttttagcagacagcattttcagacagcattttcataccaagtttgacttgtggtctccaatcttactgggaaggccctggtagtgtaattcttttccttattaaaaggtaaccaagtgcctctaagtcatgcttatttgtaaacaacaaagaagagtatatgtacctgctcaaaatttttttgataatcgcttatataattaatttctaatgatgaggacatgtaaaagttgccagtaagaacatagtatgcatttaattaaatcaagatggctaatggaattaactttctcccctgttcttgccaggtggaaatgatttaagcatttctccttgcagttgtattgaagtaaattaccataggcatcaagatggctgcatcacattttcaaatgattttatattcagttgctacttataaagcagcattcaaaaagtcttttacactgtcatgttggacacaagcagactcagcttttatcaaaacttgtttaaataaaaaattgacagtagctgggttattaaattatgcaactgaaactcctgaattatatcttttctgtatcccttaataagattggagaccactgccgtttaggataatacaataataaaacgttttaatcagtactaaaactttaattaagccaataatgatgcatgcctgttgtagctgacagcatgggtcagtacatccttcagcgagtgccttactctaattgaaaccaagcacacgtaaggtacaatatgttagactctgtgattttgttttcaaaatcctctgttatggctatatttaaatttattttaaatattcctgtatgtattcatctaagcatttgggcatttggagtcttaatatacaagaaacacgtacttaaatttttatgcttatcaccgcaatgatggcaaacagtgattttttttttcatagtttaggtgtcattgttgccagcacctttagtgctcagtcttcagtgaaaaatataaagtgccaaaaaaatcttgcaagacagaatccatacttaacactctttccaagacactgtgaccatgtacagtagctatttcctgatgaccaaatctctcaacgaatcatgttattaataaatatttttagcactcatcagtattctccaatgtgaccttctcattggagtacacagaaggaaagcaaagaagagcatctgacttctagctctggcttacagcctctctaccaggccgaagcaagagacccgcggcagcagctccccgccactcagacctgggtggtgataacctcaaagaatggctctgttttctattgacagaaaacccacttgattttgcttctgagttagcagtcagaagaccctctaagtacaatagaagtgctcttaacggactctgcctgtgtgactcccaggccccggagtctccatctctctcgtaagccacctgccacagcacagctggaggctgttctctggtgttctcagcgctccggctccctccctggagttgtgcacccgtcccaaactcctccatgcaagttctgcttcctcttataagtacacaactcagttaagtattcacatacacacagaaaatacgggtgtgaaaagaaagaattttctgtaaaaattaagttgaatactttggtaaaaagtgataaaggctgagttgccaataaaagttgcttttaaattaggtgtggctgggaatattataagatattggggaaaatatacaaatcaagaaaatttctgagcttagattgcttcatagatttatttaagtactcatcccacctttaaaacctctaaactgagaagaagggacccaaatcatgttattggtgtgatttatgtgagaagtagaactgtagtcattggacccttaggcaaaggaaaatccgtgtctttatatcagaagatcggcaaacgaatgtatattacacagtttaggttatgattccctactttaacctacttactttattaaatgaccaactactgatactgatcacaatagttattagagattctaatttagttggaaggttctaatcactttcattacaggcatttgaaaaatagggattcatttcgaatatattagccaggagcatagttagatgttacccaggccatttatcatcctgttaatgatgattttcccgacccttgtgagatcagcgtgacaggagtgtgtgtgtgtgtgtgtgtttctgtgggtgtgtggttttggttgggtgctgccaggtggcaaaggcatatgtaaatacatctgatctgcatctttatttcacagttaactaaaagtaaaaatgtctattctgattccatattgattttgtctaagatgtaaaaatttgagttcatctttggccaaaacctacctgaattaacatacaaaatatttgatttttaaaatttaattcaaatctcaaaatcaattaagtattctcagatcctatatcttggttaatatgctcccagatactttaaacatggcaaccttttggcctaagagaatgtttgttcatggaaaaaagcttttgagatgagagggtgtcttactttcttgtggcaattgattttctgttttaacaccctttgggtaaaatcttgcaaagagcttttataatttgttttactgaattgtatggagattgtataccaagtaaagctcttttaaattac

SEQ ID NO: 128057 - DNA, 2456 bp, Homo sapiens
  Payload ID: 5077
  Gene Symbol: DPY19L3
  Gene Name: dpy-19-like 3 (C. elegans)
  ENST ID: ENST00000587077
  CDS Start-End: 405-713
cggccgcgctcagagtctccggaacagaccggactcaatgcggaccaggcaagcggaagtgtgccgcttccttccggccagcgcagcacgagacgaggcggggaaccgcgggaggaggcggggcctagtgttgacgaacagctcccggggcctatgggcgcgggggcagccgcccggcctctccggcgcgccccctccccggggctgttgacgccccccagcccctcatttccacaaagctccgcggcggttctgccctccttgtacccgcggcgcgctgcggcccgtggcgcggccccgttcccgcctagccccgtcggcctccttcccctcccggagccgcgcgtgaggacggctgaggccgcaggagtgatttggagaacaatgcatgtaagtctgacatcatgatgtccatccggcaaagaagagaaataagagccacagaagtttctgaagactttccagcccaagaagaaaatgtgaagttggaaaataaattgccatctggttgtaccagtagaagattatggaagattttgtcattgacaattggtggaaccattgccctttgcattggacttcttacatctgtctaccttgccacgttacatgaaaatgatttatggttttctaatattaaggtatggagtttctttgaccattgtatcattcactcagtgggatctccagtagtaagccatgtggatgaatgaccaaggcaacacagttttgccataaagaatccaatctctagaaaggttggactatagagtgaaataacttttgtgtttattattttaaaataacatattagaatctttttttaaatttttctttattatttatttatttttgagatggagtctcactctgtcacccaggctggagtgcggtggcgcaatcttggctcactacaacctctgcctcgcaggttcaggtgattcttctggcttagcctcccaagtagctgggactataggtgcgtgccaccacacccagctaatttttgtatttttactagagacggggtttcagcatattgaccaggctgatctcgaactcctgaccttgtgatctgcctgtctcagcctcccaaagtgctgggattacaggcgtgagccactgcgtccagccagaatctttatttttcattttaattttttgagatagggtattgctctgtcacccaggctagaatgcagtggtgcaaacatgggtcactgcagcctcaacctcctgggctcaagtgagtatcctgcctaagcttcctgtgtcactgggaccccaggcatgcaccacctcaccaagctaaatttgatttttttgtagagacagggtctcactttgttgcccatgctggtctcgaactcctgggctcaagcgatcctactgccctggtcttccaaaatatgagaatgagccatagcacccagcccagaatttttataatcaagtgagttttttctttttcattaacttattccatttatttagcagttattctaaattagtatttttcaagttatagattgtgaaattagtgcagtaggtcatgagtaacatttttcttaatgaaatcaaaaagaaagaatactatcacatctagtagggttgaggattgttttgtgaaacttttaattttatatatatatatatatgcacaaactgggtcacagtatacaaggtacttccttttcttttttttcttgttggctacaacaggaaaaaaaaaaaacagaaaaggaaataaaaaagccactgctttaaatcatggggtctaaatgtggctccacagagggtcctcagcatgttcatgactatctaatactctgtgcaagtggttttgcagggcatagggcgatggggaagccatatgtttccagggaaaggaactgtaattttaatcagattttcaggagggttagccgggcgtcacgcctgtaatcccagcactttgggaggtcgaggcgggcagatcacttgaagtcaggagttcaagaccagcctggccaacatggtggaaccctatctctactaaaaatacaaaaattagccgggcatggtgacacacacctgtaatctcagctactcaggaggctgaggcacaagaatcacttgaactcgggaggaagaggttgcagtgagctgagatcccaccactgcactccagcctgggcaacagagcaatactctttatcaaaaaaaaaaagaaaaaagttgagggggtggtctgtgactctttaaacacgtttccttgttttctttctctctctctttttcaacatttctagaactcctcttggcattgttttcagaactcgtatataacttacatgtggaaatttgcatccaaatataccttacattttaatctaatatgtcatgatctttaacctaaactgtggtgtctaatgactagttgcttgtaaaaataaacaaacaccttcaaagccaaa

SEQ ID NO: 128058 - DNA, 3589 bp, Homo sapiens
  Payload ID: 5077
  Gene Symbol: DPY19L3
  Gene Name: dpy-19-like 3 (C. elegans)
  ENST ID: ENST00000588648
  CDS Start-End: 1-928
cttacagcctctttctgaaaggctgacacttcttgccattttcatatcaacttttctctttagtctgacatggcaatttaatcaatttatgatgctgatgcaagcattagtgctgttcacactggactccctggacatgctgccagcagtgaaggcgacatggctgtatggaatacagataacaagtttactcctggtctgcattcttcagttttttaattccatgattcttggatcactgcttatcagttttaacctttcagtattcattgcaagaaaacttcagaaaaatctgaaaactggaagcttccttaataggcttgggaaacttttgttacatttatttatggttttatgtttgacactttttctcaacaacataattaagaaaattcttaacctgaagtcagatgaacacatatttaaatttctgaaggcaaaatttgggcttggagcaacaagggattttgatgcaaatctctatctgtgtgaagaagcttttggcctcctgccttttaatacatttggaaggctttcagatactctgcttttttatgcttacatattcgttctgtccatcacagtgattgtagcattcgttgttgcctttcataatctcagtgattctacaaatcaacaatccgtgggtaaaatggaaaaaggcacagttgacctgaaaccagaaactgcctacaacttaatacataccattctgtttggattcttggcattgagtacaatgagaatgaagtacctctggacgtcacacatgtgtgtgttcgcatcattcggcctatgtagccctgaaatatgggagttacttctgaagtcagtccatctttataacccaaagaggatatgtataatgcgatattcagtaccgatattaatactgctgtatctatgctataagaaccagaagtcctgacacctgatttcccatcactagcaattttcctgattcacccacccaggagacaagatttgaatgagcagtaaaaatggccaaagatgagatgaccaaaaaaacagtgataggtctcaaacacagccagagatcaatcagttctggccaggaatgatggatgaactctccgagttgagagaattctatgatccagatacagtggagctgatgaactggattaactctaacactccaagaaaggctgtgtttgcgggaagcatgcagttgctggccggagtcaagctgtgcacgggaaggaccctaaccaaccacccgcactatgaagacagcagcctgagagagcggaccagagcggtttatcagatatatgccaagagggcaccagaggaagtgcatgccctcctaaggtccttcggcactgactacgtaatcctggaagacagcatctgctacgagcggaggcaccgccggggctgccgactccgggacctgctggacattgccaacggccacgccggctttcagaggctaagttgcactccagagcagaaaagcagcaagccgcttctcccttctcccttctgaggaaagtgttcttggagctatgccaggtctcagtagagcaaacagattttcaccctttagaggtgtgatgtgtgctgtaattaatggtatgaaagccaatagatatttgtaaacaagttggacaaagtgacaaacctagcctaaatttgaaaaaaaaaaatcttgactgtacagaatttgagattcagatttttgcccgaggagaatcatagttcataactgtcttgagttcagaggtggtacagaccagagacatccatttaaattttgatttgagcgtgactttttcagttatttatttatttatttatttatttttagagacagggtctcactctgtcactcagactggaatgcagtggcgtgatcttggcttactgcagcctcaaccttccaggctcaagtgatcctcccacttcagcctcccaagtagctgggaccacaggcatacatcaccatacccagctaattttgtttattttttgtaaagatggagtctggctatgttgcccagatgagtctcagactcctgatccaagcgatcctcctgcctcagcctcccaaagtgctgggatttcaggcatgagccaccacgcctggcctaaatgtgactttttctgatgagttagagagctttctctgatcactgtagttctctgtatttcatttctatgagagagacagtatagtatgttcctgagagcaagcagacctgagttctagttctggctttcccgttaatgggatcatcgtgtgacgctgcactctccttctcagccttggtctgcacttctgaagggggaaaaggatggccctgatgatctccagatgatggatggcccaggagagaatgatcctgatttgaaacctgcagaccaccctcgcttctgtgaagagatcaaaagaaacctgcctccctacgtggcctacttcaccagagtgttccagaacaaaaccttccacgtttacaagctgtccagaaacaagtagcgcagatttctgcccagtgtctatttttgatacggagaaactgcatcatgatgaaactcaatagatgacgtttcctatgtaagtaggtagcccaaaccttcaagctgtgatatgagtaagttctacagatgtttacacaagtgttgccatctttgaaagcatcttctacaagcagaagtctttttcgttgtgtgtctatctttctcattaatgttctttagcctaaatgttaacaactttctaagagtgacctagaattatgttgttggagagaatgatgtgtgttccatggatacctggataggcacataacatgttggaagatgagcacctgctcaggatttgaaatacgtttaattttcaggtgacttaagacagctatgattgaatcaactagagatgatgatcgacttatttaatatgatttcactggtgaagaccaattggtagctttttaaaaagcactttagtgtcctgttttaccttaaaatgttataatattttccagttgtcatgctgtcaacattaacaaaaaaaatcatgttaaggctttgtatcaaacattttgttacactctgtctgaaatgtaatgtggagtacttcagcagtatgtgtcatgtattgtgtgtgtctgtgtgtgtgcatgtgcacacatgtgttttaatgctgggcacagaaaagtgttacaagttccatatcgtaagtccttaaaggggcagaaatatatgtagccaagtagaatttattacattttagtgttattattttaaaacttactgatactctttaacctctcctgcagtaatagttttgctttatttcttactcatttcaatttattgggtttgcaaaattttgtaaactttttgtgtttttagcctttgtattttttacagcctagaatcttgcaaagtctgaatattttttaaatgttctatcttaactagttcactaatacagtatttttagcagacagcattttcagacagcattttcataccaagtttgacttgtggtctccaatcttactgggaaggccctggtagtgtaattcttttccttattaaaaggtaaccaagtgcctct

SEQ ID NO: 128059 - DNA, 529 bp, Homo sapiens
  Payload ID: 5077
  Gene Symbol: DPY19L3
  Gene Name: dpy-19-like 3 (C. elegans)
  ENST ID: ENST00000586427
  CDS Start-End: 152-529
gcggccgctcgcggtcttgggagagctggggcgcgtgcctgaacttcccggctgcccctgtccttggagacctacctgatggggacgccaggtgtgcaggggcgtggcgcgtaggagtgatttggagaacaatgcatgtaagtctgacatcatgatgtccatccggcaaagaagagaaataagagccacagaagtttctgaagactttccagcccaagaagaaaatgtgaagttggaaaataaattgccatctggttgtaccagtagaagattatggaagattttgtcattgacaattggtggaaccattgccctttgcattggacttcttacatctgtctaccttgccacgttacatgaaaatgatttatggttttctaatattaaggaagtggagcgagaaatctcattcagaacagagtgtggcctgtattactcctactacaagcagatgctgcaggctccaaccctcgtgcaaggttttcatggcctaatatatgataataaaactgaatctatgaagacaatt

SEQ ID NO: 128060 - DNA, 5925 bp, Homo sapiens
  Payload ID: 5077
  Gene Symbol: DPY19L3
  Gene Name: dpy-19-like 3 (C. elegans)
  ENST ID: ENST00000586987
  CDS Start-End: 68-2134
agccgcgcgtgaggacggctgaggccgcaggagtgatttggagaacaatgcatgtaagtctgacatcatgatgtccatccggcaaagaagagaaataagagccacagaagtttctgaagactttccagcccaagaagaaaatgtgaagttggaaaataaattgccatctggttgtaccagtagaagattatggaagattttgtcattgacaattggtggaaccattgccctttgcattggacttcttacatctgtctaccttgccacgttacatgaaaatgatttatggttttctaatattaaggaagtggagcgagaaatctcattcagaacagagtgtggcctgtattactcctactacaagcagatgctgcaggctccaaccctcgtgcaaggttttcatggcctaatatatgataataaaactgaatctatgaagacaattaacctccttcagcgaatgaatatttaccaagaggtttttctcagtattttatatagagttctacccatacagaaatatttagagccagtttatttttatatttacaccttatttgggctccaggcgatctatgtcacagctctctacataaccagctggctactcagtggtacatggctgtcaggactgttggcagctttctggtatgtcacaaatagaatagataccacaagagttgagtttaccatcccactgagggagaactgggcgctgccattctttgcaattcagatagcagcaattacatatttcctgagaccaaacttacagcctctttctgaaaggctgacacttcttgccattttcatatcaacttttctctttagtctgacatggcaatttaatcaatttatgatgctgatgcaagcattagtgctgttcacactggactccctggacatgctgccagcagtgaaggcgacatggctgtatggaatacagataacaagtttactcctggtctgcattcttcagttttttaattccatgattcttggatcactgcttatcagttttaacctttcagtattcattgcaagaaaacttcagaaaaatctgaaaactggaagcttccttaataggcttgggaaacttttgttacatttatttatggttttatgtttgacactttttctcaacaacataattaagaaaattcttaacctgaagtcagatgaacacatatttaaatttctgaaggcaaaatttgggcttggagcaacaagggattttgatgcaaatctctatctgtgtgaagaagcttttggcctcctgccttttaatacatttggaaggctttcagatactctgcttttttatgcttacatattcgttctgtccatcacagtgattgtagcattcgttgttgcctttcataatctcagtgattctacaaatcaacaatccgtgggtaaaatggaaaaaggcacagttgacctgaaaccagaaactgcctacaacttaatacataccattctgtttggattcttggcattgagtacaatgagaatgaagtacctctggacgtcacacatgtgtgtgttcgcatcattcggcctatgtagccctgaaatatgggagttacttctgaagtcagtccatctttataacccaaagaggatatgtataatgcgatattcagtaccgatattaatactgctgtatctatgctataagttctggccaggaatgatggatgaactctccgagttgagagaattctatgatccagatacagtggagctgatgaactggattaactctaacactccaagaaaggctgtgtttgcgggaagcatgcagttgctggccggagtcaagctgtgcacgggaaggaccctaaccaaccacccgcactatgaagacagcagcctgagagagcggaccagagcggtttatcagatatatgccaagagggcaccagaggaagtgcatgccctcctaaggtccttcggcactgactacgtaatcctggaagacagcatctgctacgagcggaggcaccgccggggctgccgactccgggacctgctggacattgccaacggccacaagccctctcttggcactttagtgactgccaccggggctgggcaagggagagatgatggatggcccaggagagaatgatcctgatttgaaacctgcagaccaccctcgcttctgtgaagagatcaaaagaaacctgcctccctacgtggcctacttcaccagagtgttccagaacaaaaccttccacgtttacaagctgtccagaaacaagtagcgcagatttctgcccagtgtctatttttgatacggagaaactgcatcatgatgaaactcaatagatgacgtttcctatgtaagtaggtagcccaaaccttcaagctgtgatatgagtaagttctacagatgtttacacaagtgttgccatctttgaaagcatcttctacaagcagaagtctttttcgttgtgtgtctatctttctcattaatgttctttagcctaaatgttaacaactttctaagagtgacctagaattatgttgttggagagaatgatgtgtgttccatggatacctggataggcacataacatgttggaagatgagcacctgctcaggatttgaaatacgtttaattttcaggtgacttaagacagctatgattgaatcaactagagatgatgatcgacttatttaatatgatttcactggtgaagaccaattggtagctttttaaaaagcactttagtgtcctgttttaccttaaaatgttataatattttccagttgtcatgctgtcaacattaacaaaaaaaatcatgttaaggctttgtatcaaacattttgttacactctgtctgaaatgtaatgtggagtacttcagcagtatgtgtcatgtattgtgtgtgtctgtgtgtgtgcatgtgcacacatgtgttttaatgctgggcacagaaaagtgttacaagttccatatcgtaagtccttaaaggggcagaaatatatgtagccaagtagaatttattacattttagtgttattattttaaaacttactgatactctttaacctctcctgcagtaatagttttgctttatttcttactcatttcaatttattgggtttgcaaaattttgtaaactttttgtgtttttagcctttgtattttttacagcctagaatcttgcaaagtctgaatattttttaaatgttctatcttaactagttcactaatacagtatttttagcagacagcattttcagacagcattttcataccaagtttgacttgtggtctccaatcttactgggaaggccctggtagtgtaattcttttccttattaaaaggtaaccaagtgcctctaagtcatgcttatttgtaaacaacaaagaagagtatatgtacctgctcaaaatttttttgataatcgcttatataattaatttctaatgatgaggacatgtaaaagttgccagtaagaacatagtatgcatttaattaaatcaagatggctaatggaattaactttctcccctgttcttgccaggtggaaatgatttaagcatttctccttgcagttgtattgaagtaaattaccataggcatcaagatggctgcatcacattttcaaatgattttatattcagttgctacttataaagcagcattcaaaaagtcttttacactgtcatgttggacacaagcagactcagcttttatcaaaacttgtttaaataaaaaattgacagtagctgggttattaaattatgcaactgaaactcctgaattatatcttttctgtatcccttaataagattggagaccactgccgtttaggataatacaataataaaacgttttaatcagtactaaaactttaattaagccaataatgatgcatgcctgttgtagctgacagcatgggtcagtacatccttcagcgagtgccttactctaattgaaaccaagcacacgtaaggtacaatatgttagactctgtgattttgttttcaaaatcctctgttatggctatatttaaatttattttaaatattcctgtatgtattcatctaagcatttgggcatttggagtcttaatatacaagaaacacgtacttaaatttttatgcttatcaccgcaatgatggcaaacagtgattttttttttcatagtttaggtgtcattgttgccagcacctttagtgctcagtcttcagtgaaaaatataaagtgccaaaaaaatcttgcaagacagaatccatacttaacactctttccaagacactgtgaccatgtacagtagctatttcctgatgaccaaatctctcaacgaatcatgttattaataaatatttttagcactcatcagtattctccaatgtgaccttctcattggagtacacagaaggaaagcaaagaagagcatctgacttctagctctggcttacagcctctctaccaggccgaagcaagagacccgcggcagcagctccccgccactcagacctgggtggtgataacctcaaagaatggctctgttttctattgacagaaaacccacttgattttgcttctgagttagcagtcagaagaccctctaagtacaatagaagtgctcttaacggactctgcctgtgtgactcccaggccccggagtctccatctctctcgtaagccacctgccacagcacagctggaggctgttctctggtgttctcagcgctccggctccctccctggagttgtgcacccgtcccaaactcctccatgcaagttctgcttcctcttataagtacacaactcagttaagtattcacatacacacagaaaatacgggtgtgaaaagaaagaattttctgtaaaaattaagttgaatactttggtaaaaagtgataaaggctgagttgccaataaaagttgcttttaaattaggtgtggctgggaatattataagatattggggaaaatatacaaatcaagaaaatttctgagcttagattgcttcatagatttatttaagtactcatcccacctttaaaacctctaaactgagaagaagggacccaaatcatgttattggtgtgatttatgtgagaagtagaactgtagtcattggacccttaggcaaaggaaaatccgtgtctttatatcagaagatcggcaaacgaatgtatattacacagtttaggttatgattccctactttaacctacttactttattaaatgaccaactactgatactgatcacaatagttattagagattctaatttagttggaaggttctaatcactttcattacaggcatttgaaaaatagggattcatttcgaatatattagccaggagcatagttagatgttacccaggccatttatcatcctgttaatgatgattttcccgacccttgtgagatcagcgtgacaggagtgtgtgtgtgtgtgtgtgtttctgtgggtgtgtggttttggttgggtgctgccaggtggcaaaggcatatgtaaatacatctgatctgcatctttatttcacagttaactaaaagtaaaaatgtctattctgattccatattgattttgtctaagatgtaaaaatttgagttcatctttggccaaaacctacctgaattaacatacaaaatatttgatttttaaaatttaattcaaatctcaaaatcaattaagtattctcagatcctatatcttggttaatatgctcccagatactttaaacatggcaaccttttggcctaagagaatgtttgttcatggaaaaaagcttttgagatgagagggtgtcttactttcttgtggcaattgattttctgttttaacaccctttgggtaaaatcttgcaaagagcttttataatttgttttactgaattgtatggagattgtataccaagtaaagctcttttaaattacataaga

SEQ ID NO: 128061 - DNA, 556 bp, Homo sapiens
  Payload ID: 5077
  Gene Symbol: DPY19L3
  Gene Name: dpy-19-like 3 (C. elegans)
  ENST ID: ENST00000592832
  CDS Start-End: 1-404
ttaatacatttggaaggctttcagatactctgcttttttatgcttacatattcgttctgtccatcacagtgattgtagcattcgttgttgcctttcataatctcagtgattctacaaatcaacaatccgtgggtaaaatggaaaaaggcacagttgacctgaaaccagaaactgcctacaacttaatacataccattctgtttggattcttggcattgagtacaatgagaatgaagtacctctggacgtcacacatgtgtgtgttcgcatcattcggcctatgtagccctgaaatatgggagttacttctgaagtcagtccatctttataacccaaagaggatatgtataatgcgatattcagtaccgatattaatactgctgtatctatgctataagctctaacactccaagaaaggctgtgtttgcgggaagcatgcagttgctggccggagtcaagctgtgcacgggaaggaccctaaccaaccacccgcactatgaagacagcagcctgagagagcggaccagagcggtttatcagatatatgccaagaggg

SEQ ID NO: 128062 - DNA, 6197 bp, Homo sapiens
  Payload ID: 5078
  Gene Symbol: DPY19L4
  Gene Name: dpy-19-like 4 (C. elegans)
  Uniprot ID: Q7Z388
  ENST ID: ENST00000414645
  CDS Start-End: 100-2271
aggagcgggcccccggaggccgaggggttcggcgacgcggagggagggagagtctgggccgcgcgggagccgcagggcgccctagccttcgcagaaacgatggcggaggaagaaggaccacctgtagagctgcgccaaagaaaaaagccaaagtcttcagaaaataaggaatctgccaaagaagagaaaatcagtgacattccaattcctgaaagagctccaaaacatgtattatttcaacgctttgcaaagattttcattggctgtcttgcagcggttactagtggtatgatgtatgctctctacttatcagcataccatgaacggaaattctggttttccaacaggcaggagcttgaacgggaaatcacgtttcagggtgacagtgccatttattactcctattataaagatatgttaaaggcaccttcatttgaaagaggtgtttacgaactgacacacaataacaaaactgtatctctgaagactataaatgcagtgcagcaaatgtctctgtatccggaacttattgctagcattttatatcaagccactggtagcaatgagattattgagccagtgtatttctatattggcattgtttttggattgcaaggaatatatgttactgctttatttgttacaagttggcttatgagtggaacatggctagcaggaatgcttactgttgcgtggttcgttattaacagggtagatacaacaagaattgaatactccattcctttaagagaaaactgggcactaccatattttgcatgccaaattgctgcacttacaggctatttaaaaagcaacttaaatacttatggagagaggttttgctacttgttgatgagtgcttcaacttacacatttatgatgatgtgggagtatagccactatctcctgtttcttcaagcaatatctctattcctgctagataccttttcagtggagcaaagtgacaaggtttatgaagtttataaaatctacatattttccctctttctgggatatttactacagtttgagaatccagctttgttggtatctcctttattaagtttagtagcagccttaatgcttgctaagtgccttcagctgaatgtgaagaaaggaagttttgtagctaaaataataaaagtgattaatttttacttggtgtgtactctgacaataacattgaatattataatgaagatgtttgtcccacacaaagaaaatgggcacatgctgaaattccttgaagtaaaatttggactaaatatgaccaagaattttacaatgaattggctcctctgtcaagaatccctgcaggcaccatctcaagatttttttctgcgattgacacagtcttctttattacctttctacattctagtgttaattatttgttttctttctatgttgcaagttatttttaggaggattaatggtaagtccctgaaggaaactgttactcttgaagatggacgaattggagaaagaccagaaataatttatcatgtaattcacactattttattgggttctcttgcaatggttatagaaggcttgaagtacatctggattccttatgtgtgcatgttagcagcatttggtgtatgttctcccgaactttggatgacacttttcaagtggcttcgattaagaactgtacacccaatattgttggctcttattctgagcatggccgtgcctactataataggtctcagcttatggaaagagttttttcccagattaatgacagaattaatggaactacaggaattctatgacccagatacagtggaacttatgacctggataaaaaggcaagctccagttgcagctgtgtttgcagggagtccacagttaatgggtgcgattaaattatgcactggatggatggtgacaagtttgcctctttacaatgatgatgatcttctcaagagaaatgaaaatatctaccaaatctattcaaagcgatctgctgaggatatttataaaatactgacatcttacaaagctaattacctaattgtagaggatgctatctgcaatgaggtgggacccatgagaggctgtagggttaaagatttattagacattgcaaatggccacatggtttgtgaagaaggtgacaagctaacctactcaaaatatgggcgattttgtcatgaggtcaaaattaactattctccatatgtgaattatttcactagagtatactggaacagatcctactttgtatataaaatcaacactgtgatatccttccagtcttgaaaaataacagagccttcatttcaaagactacctgaagtaaaatgcagttttcttctacctactcggtgtcttttgcagatcagagtatggacatttgaaatattgctgcttctttcccccttctgctgttaactggatccagagttctgtgggaaatagaagatcaagcattactgtcctttgattaaatgtgatatctaccactctgcaatattccagacaggtgtcttccttaccgttacatggtctttaacacttttactgattgcaatattttccccataaaatcttcattctattataatattgatcttgaatttgaatatgtgcaaggtcagatacatttctcaaacataacatttaataaataatgtgatataattatttaatagaaagaataattccgaccttcaagcaagtttctgaaggtattttatgatgtataacaactgaagttttacaataaaaactaatttaaatgttagctgaagatatgtggcatttaaattaaaatggaaattatataaaggaaagtgatttttaaggatatacataaagatatatttagaattttcatgatactgttctcctcatctactgcttatgttaagtgagaactttcttagtaatacataatgcatgatgttactgcattttctaaatgactagtaagtgattagttttttcacttatgcctattaatttgataccaatttaatcatgataaaacaataaccgttaacatatattttgttaaatggacatttaaaagaatgttgttcaggttttttttttaaatactgatatggggcatacaatctattcacatgttttctactgaagtactaagtaaaaaaattaaatcattatcagaataaaaatatgtgttctaaaattagcaacaatttctggggatacatgcagatgttgttaaacgtacctctgcatacagatatattataaaacacaagcaatgttatttatgaaactgtgatgcagtcttcaacatcaagaaaaaatgacaactataataaaatttacaacacagtttcacagtctaaatgctatgttcctttaagtattttcatatttttaatcatttattaagagaaaattgtgaaaagttaatttggccttatagagagattcaggatagatgtagcctatagatgtgtcattttaataagttgggatacatgtttagtttttccttatattcctgttcagtgaacagattttcataattctcacttgttaaagtgctgcaaaaattgcattttcagtactctaaattactacattagaagagagcatttctccattgtctttattttctgttatatatgtgttgtaaaagtacactacattagaagggagcttttccgttgtctttattttctgttatacatgtgttgttaaagtacatgcattcttagactaactctcagatgctttgctcttttggagctgaagaattgtttgatggtgatgtcatatatctgatagattagtttcagtggttctcatttcacttttatacgtaatttcttaactatattaagatagttgcaggcagtgtacctcaggttgactctgtacatctgaatagtgagtcactagtattttgcttcaagccttctgaaaatataaccatagttacctaagcacacagtgaatagtcacatggtagtacttgtgattagagcatgtaaaacaatgtaattgaaaagtcagcttccatattttgtaggggaaatagaacaccctactttttatctagtgtgaaatatttaatcgaatttttgttgatttatattatgttacctgtgctgaattaggtttggtacttgtgttttgtttgacatattagtaagttgcttttgcttctttctgtcaacttattttttaaataaaattgatctggaaaaattgttaatgggatgttttaaataatgaatttttcatccagcatcagttgaaaaggaaaagaaagcttcattatggaaatgacaatattgaatatgacagataagtttatttgcttctgttttaactgcagttaatagtactagacaactttaagtggaaagcatttagtttatttcttcacttatttgtagagtgaacaaatgattcacaattctacaagtaattccacttaggtaacttacagttgttaggtttgacaataaagatctactatgagaggagaagaatttatgggttttgggtggaaggaatttctcaaagaaataaaaaatgttctttgcccttgatactgcaaacccactgatacaagtgccttgaatttattattattattattttttatttttttgagatggagtttcactcttgtctcccaggctggagtgcaatggcgcgatcttggctcactgcaacctccgctcgctgcaacctccgcctcccaggttcaagtgattctcctgcctcagcctccggagtagctgggattacaggcacctgccaccaagcacggctaatttttgtatttttagtagaaacggggtttcgccatgttggccaggctggtctcgaactcctgacctcagatgatccactcaccccagcctcccaaagtgctgggattacagacgtgagccactgcgcccggcgcaagtctttgttaaaagtagagatggaggccaggcgcagtggctcactcctgtaatcccagcactttgggaggctgaggcaggcagatcacgaggtcaggagatcgagaccatcttggctaacacggtgaaaccccgtctctactgaaaatacaaaaaattagccgggcagggtggcgggcgcctgtagtcccagctactccgaggctgaagcaggagaatggcgtcaagcggcgaggcggagcttgcggtgagccgagatcatgccgctgcactccagcctgggcaacagagcaagactccatctcaaaaagaaaaaaaaagtagagatgggatctctagcctcctaagttaatttagcctcccaaatgccagacaaagaatctaacataaaatttaccttgaataagatatatgatattgattctgagctgctttgtattttttctgactttggcatctgtatcttggtgctttctgttagactggtagagtttaagaacctaaggagtatgcattgtacttcagtgctaacttttttcttcatttactttctgtgtatataggcagcatattttttttgtagaacattaacccagattgctaatagcttcatgttacggcattcttccacacagtccagattgatttaaggaaaagcagaaatggaagtcaaagtgtgttataaattgagactgaaaaacatgctttaaaaaatagatttaatttcttacactgtgaatagccattgtattgttttgtttctgataaatcagttgttttgggcccctatttttgaactgttaaaaaattttgatgcttttcgtggataaaagtagtgcctctctttatacaactgatggggttttaaaaagtgtaaattgccttttttgttaaacttattttaaatgctttagtatttaaagggtgtatgttattaattaatctgcatatttgtaacgcaaataactacttcctgatttacatctcaatatattcttctttcatttgcccaatttaaaaaatacgtagtctctattgttgctgtttactaatagttttagatcccaatgtgtattagaattatagctacaaaaagttgcaagtaaaatttagcaatttcctattcaaacaggatctcattagtatgttttttaatgtgtagaattaacactttaaaataaacaggtgtgaaaattataaaggaatatatatgacaattattttctgtacattaatgtctaaacattatacttactttttcataataaaggaaattttggaaccaaa

SEQ ID NO: 128063 - DNA, 340 bp, Homo sapiens
  Payload ID: 5078
  Gene Symbol: DPY19L4
  Gene Name: dpy-19-like 4 (C. elegans)
  ENST ID: ENST00000519353
  CDS Start-End: 1-340
gaagagaaaatcagtgacattccaattcctgaaagagctccaaaacgagcttgaacgggaaatcacgtttcagggtgacagtgccatttattactcctattataaagatatgttaaaggcaccttcatttgaaagaggtgtttacgaactgacacacaataacaaaactgtatctctgaagactataaatgcagtgcagcaaatgtctctgtatccggaacttattgctagcattttatatcaagccactggtagcaatgagattattgagccagtgtatttctatattggcattgtttttggattgcaaggaatatatgttactgctttatttgttaca

SEQ ID NO: 128064 - DNA, 680 bp, Homo sapiens
  Payload ID: 5078
  Gene Symbol: DPY19L4
  Gene Name: dpy-19-like 4 (C. elegans)
  ENST ID: ENST00000522422
  CDS Start-End: 297-680
ggcggcggccaggagctacagctgtgggctgcactcccggcgtggagtctccttcctgcccgcgcaggccccggcgccccagcgaaacgctccggccgctcccctctcccaacactctggttcccgggccgcctgcggggacgcggttggcggcgacaccggaggggggtgggtcaggaagtgggggcgcggcggccaggagcgggcccccggaggccgaggggttcggcgacgcggagggagggagagtctgggccgcgcgggagccgcagggcgccctagccttcgcagaaacgatggcggaggaagaaggaccacctgtagagctgcgccaaagaaaaaagccaaagtcttcagaaaataaggaatctgccaaagaagagaaaatcagtgacattccaattcctgaaagagctccaaaacgtgtttacgaactgacacacaataacaaaactgtatctctgaagactataaatgcagtgcagcaaatgtctctgtatccggaacttattgctagcattttatatcaagccactggtagcaatgagattattgagccagtgtatttctatattggcattgtttttggattgcaaggaatatatgttactgctttatttgttacaagttggcttatgagtggaacatggctagcaggaatgcttactgttgcgtggttc

SEQ ID NO: 128065 - DNA, 802 bp, Homo sapiens
  Payload ID: 5078
  Gene Symbol: DPY19L4
  Gene Name: dpy-19-like 4 (C. elegans)
  ENST ID: ENST00000521525
  CDS Start-End: 1-204
gccactggtagcaatgagattattgagccagtgtatttctatattggcattgtttttggattgcaaggaatatatgttactgctttatttgttacaagttggcttatgagtggaacatggctagcaggaatgcttactgttgcgtggttcgttattaacagggcagcatgcaacttggcagctggtctcccttacagtgaatgatccaagagagtatgagagagtgtgccacaatggaagccaggtatctgttataacctcatcttagaaatgatataacatcactctgccatattttgtcagttgcacagacccctggtacagtgtgggaggtgacaacacaggatattaataccaggaggcaggaatcattgggaccgtcttggaggctggctaccacattcaattaactttgctattaatttcatgtaatccctatatctgtcttcatatttgaagaggaaaagatactttctcatgtaaacataatggttttaaagaataagactctcttatgctacttaaacaaaagaataagactctctttagagatcttagtgagaattgtaagaaataaaataaacagaagtctgactgccttatttgatgtcactgatgtatgttgtattgctggagtagaagttaaatagaaaaattgacctggtatattctactcaaatgtatcttttgacaattgaaatgttcttaatagctaagttttaaaaaatgcgtttgtttgctttttgtttatattttattggtatgtatcttgtactgcaaaatacattttaatgccatgaaa

SEQ ID NO: 128066 - DNA, 548 bp, Homo sapiens
  Payload ID: 5078
  Gene Symbol: DPY19L4
  Gene Name: dpy-19-like 4 (C. elegans)
  ENST ID: ENST00000522669
  CDS Start-End: 1-226
ctggattccttatgtgtgcatgttagcagcatttggtgtatgttctcccgaactttggatgacacttttcaagtggcttcgattaagaactgtacacccaatattgttggctcttattctgagcatggccgtgcctactataataggtctcagcttatggaaagagaaggcaagctccagttgcagctgtgtttgcagggagtccacagttaatgggtgcgattaaattatgcactggatggatggtgacaagtttgcctctttacaatgatgatgatcttctcaagagaaatgaaaatatctaccaaatctattcaaagcgatctgctgaggatatttataaaatactgacatcttacaaagctaattacctaattgtagaggatgctatctgcaatgaggtgggacccatgagaggctgtagggttaaagatttattagacattgcaaatggccacatggtttgtgaagaaggtgacaagctaacctactcaaaatatgggcgattttgtcatgaggtcaaaattaactattctccatatgtgaat

SEQ ID NO: 128067 - DNA, 828 bp, Homo sapiens
  Payload ID: 5078
  Gene Symbol: DPY19L4
  Gene Name: dpy-19-like 4 (C. elegans)
  ENST ID: ENST00000523020
  CDS Start-End: 1-828
tattgagccagtgtatttctatattggcattgtttttggattgcaaggaatatatgttactgctttatttgttacaagttggcttatgagtggaacatggctagcaggaatgcttactgttgcgtggttcgttattaacagggtagatacaacaagaattgaatactccattcctttaagagaaaactgggcactaccatattttgcatgccaaattgctgcacttacaggctatttaaaaagcaacttaaatacttatggagagaggttttgctacttgttgatgagtgcttcaacttacacatttatgatgatgtgggagtatagccactatctcctgtttcttcaagcaatatctctattcctgctagataccttttcagtggagcaaagtgacaagctgaatgtgaagaaaggaagttttgtagctaaaataataaaagtgattaatttttacttggtgtgtactctgacaataacattgaatattataatgaagatgtttgtcccacacaaagaaaatgggcacatgctgaaattccttgaagtaaaatttggactaaatatgaccaagaattttacaatgaattggctcctctgtcaagaatccctgcaggcaccatctcaagatttttttctgcgattgacacagtcttctttattacctttctacattctagtgttaattatttgttttctttctatgttgcaagttatttttaggaggattaatggtaagtccctgaaggaaactgttactcttgaagatggacgaattggagaaagaccagaaataatttatcatgtaattcacactattttattggg

SEQ ID NO: 128068 - DNA, 581 bp, Homo sapiens
  Payload ID: 5078
  Gene Symbol: DPY19L4
  Gene Name: dpy-19-like 4 (C. elegans)
  ENST ID: ENST00000520774
  CDS Start-End: 125-259
gtcaggaagtgggggcgcggcggccaggagcgggcccccggaggccgaggggttcggcgacgcggagggagggagagtctgggccgcgcgggagccgcagggcgccctagccttcgcagaaacgatggcggaggaagaaggaccacctgtagagctgcgccaaagaaaaaagccaaagtcttcagaaaataaggaatctgccaaagaagagaaaatcagtgacattccaattcctgaaagagctccaaaacgagcttgaacgggaaatcacgtttcagggtgacagtgccatttattactcctattataaagatatgttaaaggcaccttcatttgaaagaggtgtttacgaactgacacacaataacaaaactgtatctctgaagactataaatgcagtgcagcaaatgtctctgtatccggaacttattgctagcattttatatcaagccactggtagcaatgagattattgagccagtgtatttctatattggcattgtttttggattgcaaggaatatatgttactgctttatttgttacaagttggcttatgagtggaacatggctagcaggaatg

SEQ ID NO: 128069 - DNA, 1124 bp, Homo sapiens
  Payload ID: 5078
  Gene Symbol: DPY19L4
  Gene Name: dpy-19-like 4 (C. elegans)
  ENST ID: ENST00000519176
  CDS Start-End: 1-573
aaaatcagtgacattccaattcctgaaagagctccaaaacatgtattatttcaacgctttgcaaagattttcattggctgtcttgcagcggttactagtggtatgatgtatgctctctacttatcagcataccatgaacggaaattctggttttccaacaggcaggagcttgaacgggaaatcacgtttcagggtgacagtgccatttattactcctattataaagatatgttaaaggcaccttcatttgaaagaggtgtttacgaactgacacacaataacaaaactgtatctctgaagactataaatgcagtgcagcaaatgtctctgtatccggaacttattgctagcattttatatcaagccactggtagcaatgagattattgagccagtgtatttctatattggcattgtttttggattgcaaggaatatatgttactgctttatttgttacaagttggcttatgagtggaacatggctagcaggaatgcttactgttgcgtggttcgttattaacagttgcacagacccctggtacagtgtgggaggtgacaacacaggatattaataccaggaggcaggaatcattgggaccgtcttggaggctggctaccacattcaattaactttgctattaatttcatgtaatccctatatctgtcttcatatttgaagaggaaaagatactttctcatgtaaacataatggttttaaagaataagactctcttatgctacttaaacaaaagaataagactctctttagagatcttagtgagaattgtaagaaataaaataaacagaagtctgactgccttatttgatgtcactgatgtatgttgtattgctggagtagaagttaaatagaaaaattgacctggtatattctactcaaatgtatcttttgacaattgaaatgttcttaatagctaagttttaaaaaatgcgtttgtttgctttttgtttatattttattggtatgtatcttgtactgcaaaatacattttaatgccatgaaagaatatgctgtctctttattcatcagctttatagcttttatttatatatgacttcttagaaaagtataaaaagatattaaagtcattccattatattatga

SEQ ID NO: 128070 - DNA, 612 bp, Homo sapiens
  Payload ID: 5079
  Gene Symbol: DYDC1
  Gene Name: DPY30 domain containing 1
  Uniprot ID: Q8WWB3
  ENST ID: ENST00000372202
  CDS Start-End: 52-585
cgggacgccgctcctgggtggcgagcaggcgcgtgtgtaggggagttagaaatggagtcaatatatcttcaaaagcaccttggggcctgtttaactcaaggtcttgcagaagtggcaagagttcgcccagtggatccgatagaatatttagcattgtggatttacaagtataaggaaaatgtgaccatggaacaactgagacaaaaggaaatggccaagctggagcgtgaaagagaattagctctgatggagcaggaaatgatggagaggctcaaagcagaggagctcttacttcagcagcaacagctggcattgcagctagagttggaaatgcaagaaaaggagaggcagagaatacaagaactacagagagctcaagaacaattaggcaaggagatgagaatgaatatggaaaatctagttaggaatgaagatattctacattcagaggaagcaacactagactcaggcaaaacactagctgaaatcagcgatcgttatggagcacctaacttgagcagagtggaagaacttgatgaaccaatgttttctgatattgcattaaacattgatcaagatttgtaggaccaaccaacctaagagcaataaatg

SEQ ID NO: 128071 - DNA, 750 bp, Homo sapiens
  Payload ID: 5079
  Gene Symbol: DYDC1
  Gene Name: DPY30 domain containing 1
  Uniprot ID: Q8WWB3
  ENST ID: ENST00000372204
  CDS Start-End: 166-699
gctcctgggtggcgagcaggcgcgtgtgtagggacgaagtttcactcttgttgcccaggctggagtgcaatggcacaatctcagctcactgcaacctctgcctcccgggttcaagtgattctcctgcctcagccttccaagtagctgggattacaggagttagaaatggagtcaatatatcttcaaaagcaccttggggcctgtttaactcaaggtcttgcagaagtggcaagagttcgcccagtggatccgatagaatatttagcattgtggatttacaagtataaggaaaatgtgaccatggaacaactgagacaaaaggaaatggccaagctggagcgtgaaagagaattagctctgatggagcaggaaatgatggagaggctcaaagcagaggagctcttacttcagcagcaacagctggcattgcagctagagttggaaatgcaagaaaaggagaggcagagaatacaagaactacagagagctcaagaacaattaggcaaggagatgagaatgaatatggaaaatctagttaggaatgaagatattctacattcagaggaagcaacactagactcaggcaaaacactagctgaaatcagcgatcgttatggagcacctaacttgagcagagtggaagaacttgatgaaccaatgttttctgatattgcattaaacattgatcaagatttgtaggaccaaccaacctaagagcaataaatgtttttgtttgtttcaaatttcaaa

SEQ ID NO: 128072 - DNA, 750 bp, Homo sapiens
  Payload ID: 5079
  Gene Symbol: DYDC1
  Gene Name: DPY30 domain containing 1
  ENST ID: ENST00000453477
  CDS Start-End: 511-750
aacgggacgccgctcctgggtggcgagcaggcgcgtgtgtaggggtgagcgcaccggaaaggcccgaactgtttttgggatttgttcccctagcttcgctgggtccggcgggcagaggcggttctgaccgttgggccttgggcgtcgagcaggactcacctgaggcggagagaggccgcttcgcgcctggggctcccgaaagcggccagctgtcctcctgctccccctgagcggggagcgctgcgtctcctgcgggctgcgggagacccttccagactcccgggtgggaaaaccacactgagcgccccgggaggttgccagatacaatactgtatctggcacccctgcccgggtgcccccgcccagttggctggctggctggctagctgtctcccaggtgtgggctggagtgcaatggcacaatctcagctcactgcaacctctgcctcccgggttcaagtgattctcctgcctcagccttccaagtagctgggattacaggagttagaaatggagtcaatatatcttcaaaagcaccttggggcctgtttaactcaaggtcttgcagaagtggcaagagttcgcccagtggatccgatagaatatttagcattgtggatttacaagtataaggaaaatgtgaccatggaacaactgagacaaaaggaaatggccaagctggagcgtgaaagagaattagctctgatggagcaggaaatgatggagaggctcaaagcagaggagctctta

SEQ ID NO: 128073 - DNA, 708 bp, Homo sapiens
  Payload ID: 5079
  Gene Symbol: DYDC1
  Gene Name: DPY30 domain containing 1
  Uniprot ID: Q8WWB3
  ENST ID: ENST00000421924
  CDS Start-End: 127-660
ggtgtccatgactgagggcagggtgtatgtaaggctttgttcacctcactggactttagttttatagtgactttattgaaaatatcctgcagtaatgcaaaaacacttactttttaggagttagaaatggagtcaatatatcttcaaaagcaccttggggcctgtttaactcaaggtcttgcagaagtggcaagagttcgcccagtggatccgatagaatatttagcattgtggatttacaagtataaggaaaatgtgaccatggaacaactgagacaaaaggaaatggccaagctggagcgtgaaagagaattagctctgatggagcaggaaatgatggagaggctcaaagcagaggagctcttacttcagcagcaacagctggcattgcagctagagttggaaatgcaagaaaaggagaggcagagaatacaagaactacagagagctcaagaacaattaggcaaggagatgagaatgaatatggaaaatctagttaggaatgaagatattctacattcagaggaagcaacactagactcaggcaaaacactagctgaaatcagcgatcgttatggagcacctaacttgagcagagtggaagaacttgatgaaccaatgttttctgatattgcattaaacattgatcaagatttgtaggaccaaccaacctaagagcaataaatgtttttgtttgtttcaaatttc

SEQ ID NO: 128074 - DNA, 829 bp, Homo sapiens
  Payload ID: 5079
  Gene Symbol: DYDC1
  Gene Name: DPY30 domain containing 1
  ENST ID: ENST00000454362
  CDS Start-End: 372-829
ggggtgagcgcaccggaaaggcccgaactgtttttgggatttgttcccctagcttcgctgggtccggcgggcagaggcggttctgaccgttgggccttgggcgtcgagcaggactcacctgaggcggagagaggccgcttcgcgcctggggctcccgaaagcggccagctgtcctcctgctccccctgagcggggagcgctgcgtctcctgcgggctgcgggagacccttccagactcccgggtgggaaaaccacactgagcgccccgggaggttgccagatacaatactgtatctggcacccctgcccgggtgcccccgcccagttggctggctggctggctagctgtctcccaggtgtgggagttagaaatggagtcaatatatcttcaaaagcaccttggggcctgtttaactcaaggtcttgcagaagtggcaagagttcgcccagtggatccgatagaatatttagcattgtggatttacaagtataaggaaaatgtgaccatggaacaactgagacaaaaggaaatggccaagctggagcgtgaaagagaattagctctgatggagcaggaaatgatggagaggctcaaagcagaggagctcttacttcagcagcaacagctggcattgcagctagagttggaaatgcaagaaaaggagaggcagagaatacaagaactacagagagctcaagaacaattaggcaaggagatgagaatgaatatggaaaatctagttaggaatgaagatattctacattcagaggaagcaacactagactcaggcaaaacactagctgaaatcagcgatcgttatggagcacc

SEQ ID NO: 128075 - DNA, 1842 bp, Homo sapiens
  Payload ID: 5080
  Gene Symbol: DYDC2
  Gene Name: DPY30 domain containing 2
  Uniprot ID: Q96IM9
  ENST ID: ENST00000256039
  CDS Start-End: 187-720
aaagcggaaggggcgcgcggatagagctcccagtgtgccaagcgtgggcggtatacagtaaacaaagacaacccctattcttatcaccttgcctactgagtgcaagtccaggaactgtgtaagcagaccctcagaggagctctgggaaacactgaaaaatagcctctccccccattggctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccaggtacttccagtctgattccaggaatgcctcaacaggttcctccttcagagtctgctggccagattgaccagaacttcaaaatgccacaagaaataaattacaaggaggcttttcagcatgaagttgctcatgaaatgcctcctggctccaaatctcctttttaggttacagaaggtagatgcttctgatttacttctctcaaagctagaagccaagaaaatggccagctagaaccaagatttaaggggctgtaaaaggcaagttcagggactctccagcctactccttttctgaaaaacccttaatcatgtgaacatttgaactagttataggataaaataaactcagaataaggatttaaaataagtaaccaagtggctgtgactttttcctcttgttttatcaacgttttggagactacacaatgaaaacacatctgttggggtgatcagacccaacacccggccatgggggctacaaagtccagccgagtcaaaggaaagagaaaagacaagtcaagagagaaagtgggaccagggggccaatgctagtatggaggctgtgaagtccccaagctctggaagcccacactatttgttggtgatcaaacaaagaaacaggtgatgaggatgtgggagttgaaagaaagtggtgtatcaagcgaatgaactacagctgtgagggtttagcattttctttgaaacatatggctacttgagataatgggagtgctagaagcaaggagccagcaagtctggacacattacaaaggccacaaggggttttatcctggaccccggacatgttccaagccctgcctcaacttttctcccaacactaagctttcctcccaacacacatccatctcgtgtgttcatgtcttaacttttgcttcacttcacagtcaggcctctccgagtattttttacacatatcctggagtctacctatgtcactgatagcagatatttttcttcaacatatattatcaatgttttaatacttttcttcaattttagtaactggtaaaatacatgtaagatgtaccatcttaaccatttttaagtgtacagatcagttgtattaagtagattcatattcttgtgcaaccatcatcaccatccggctgcaaaactctttcatcttgcaaaactgaaactctacacccattaaaaaataactcgccatttctctctctccccagcccctggcaaccaccattctttctgtctctgtgatttagattactctgtaagtatgttgtataaatagactcatacaatgtt

SEQ ID NO: 128076 - DNA, 2022 bp, Homo sapiens
  Payload ID: 5080
  Gene Symbol: DYDC2
  Gene Name: DPY30 domain containing 2
  Uniprot ID: Q96IM9
  ENST ID: ENST00000372197
  CDS Start-End: 367-900
aagaagtgcctttcgcctcccaccatgattctgagacctccccagcaatgtggaactaaacagctgcctccagcgtgaagaaggtgccacagagatggaaggagattccttacccacacctgggagacagctagccagccagccagccaactgggcgggggcacccgggcaggggtgccagatacagtattgtatctggcaacctcccggggcgctcagtgtggttttcccacccgggagtctggaagggtctcccgcagcccgcaggagacgcagcgctccccgctcagggggagcaggaggacagctggccgctttcgggagccccaggcgcgaagcggcctctctccgcctcaggctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccaggtacttccagtctgattccaggaatgcctcaacaggttcctccttcagagtctgctggccagattgaccagaacttcaaaatgccacaagaaataaattacaaggaggcttttcagcatgaagttgctcatgaaatgcctcctggctccaaatctcctttttaggttacagaaggtagatgcttctgatttacttctctcaaagctagaagccaagaaaatggccagctagaaccaagatttaaggggctgtaaaaggcaagttcagggactctccagcctactccttttctgaaaaacccttaatcatgtgaacatttgaactagttataggataaaataaactcagaataaggatttaaaataagtaaccaagtggctgtgactttttcctcttgttttatcaacgttttggagactacacaatgaaaacacatctgttggggtgatcagacccaacacccggccatgggggctacaaagtccagccgagtcaaaggaaagagaaaagacaagtcaagagagaaagtgggaccagggggccaatgctagtatggaggctgtgaagtccccaagctctggaagcccacactatttgttggtgatcaaacaaagaaacaggtgatgaggatgtgggagttgaaagaaagtggtgtatcaagcgaatgaactacagctgtgagggtttagcattttctttgaaacatatggctacttgagataatgggagtgctagaagcaaggagccagcaagtctggacacattacaaaggccacaaggggttttatcctggaccccggacatgttccaagccctgcctcaacttttctcccaacactaagctttcctcccaacacacatccatctcgtgtgttcatgtcttaacttttgcttcacttcacagtcaggcctctccgagtattttttacacatatcctggagtctacctatgtcactgatagcagatatttttcttcaacatatattatcaatgttttaatacttttcttcaattttagtaactggtaaaatacatgtaagatgtaccatcttaaccatttttaagtgtacagatcagttgtattaagtagattcatattcttgtgcaaccatcatcaccatccggctgcaaaactctttcatcttgcaaaactgaaactctacacccattaaaaaataactcgccatttctctctctccccagcccctggcaaccaccattctttctgtctctgtgatttagattactctgtaagtatgttgtataaatagactcatacaatgtt

SEQ ID NO: 128077 - DNA, 1736 bp, Homo sapiens
  Payload ID: 5080
  Gene Symbol: DYDC2
  Gene Name: DPY30 domain containing 2
  ENST ID: ENST00000372198
  CDS Start-End: 39-614
tgctgccaccatgtaagaagtgcctttcgcctcccaccatgattctgagacctccccagcaatgtggaactgctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccaggtacttccagtctgattccaggaatgcctcaacaggttcctccttcagagtctgctggccagattgaccagaacttcaaaatgccacaagaaataaattacaaggaggcttttcagcatgaagttgctcatgaaatgcctcctggctccaaatctcctttttaggttacagaaggtagatgcttctgatttacttctctcaaagctagaagccaagaaaatggccagctagaaccaagatttaaggggctgtaaaaggcaagttcagggactctccagcctactccttttctgaaaaacccttaatcatgtgaacatttgaactagttataggataaaataaactcagaataaggatttaaaataagtaaccaagtggctgtgactttttcctcttgttttatcaacgttttggagactacacaatgaaaacacatctgttggggtgatcagacccaacacccggccatgggggctacaaagtccagccgagtcaaaggaaagagaaaagacaagtcaagagagaaagtgggaccagggggccaatgctagtatggaggctgtgaagtccccaagctctggaagcccacactatttgttggtgatcaaacaaagaaacaggtgatgaggatgtgggagttgaaagaaagtggtgtatcaagcgaatgaactacagctgtgagggtttagcattttctttgaaacatatggctacttgagataatgggagtgctagaagcaaggagccagcaagtctggacacattacaaaggccacaaggggttttatcctggaccccggacatgttccaagccctgcctcaacttttctcccaacactaagctttcctcccaacacacatccatctcgtgtgttcatgtcttaacttttgcttcacttcacagtcaggcctctccgagtattttttacacatatcctggagtctacctatgtcactgatagcagatatttttcttcaacatatattatcaatgttttaatacttttcttcaattttagtaactggtaaaatacatgtaagatgtaccatcttaaccatttttaagtgtacagatcagttgtattaagtagattcatattcttgtgcaaccatcatcaccatccggctgcaaaactctttcatcttgcaaaactgaaactctacacccattaaaaaataactcgccatttctctctctccccagcccctggcaaccaccattctttctgtctctgtgatttagattactctgtaagtatgttgtataaatagactcatacaatgtt

SEQ ID NO: 128078 - DNA, 2254 bp, Homo sapiens
  Payload ID: 5080
  Gene Symbol: DYDC2
  Gene Name: DPY30 domain containing 2
  Uniprot ID: Q96IM9
  ENST ID: ENST00000372199
  CDS Start-End: 599-1132
tgctgccaccatgtaagaagtgcctttcgcctcccaccatgattctgagacctccccagcaatgtggaactaaggagattcctacttaccagttgttccatggtcacattttccttatacttgtaaatccacaatgctaaatattctatcggatccactgggcgaactcttgccacttctgcaagaccttgagttaaacaggccccaaggtgcttttgaagatatattgactccatttctaactcctaaaaagcatcttggctcaacataagaaagccctttcccacagaaacagctgcctccagcgtgaagaaggtgccacagagatggaaggagattccttacccacacctgggagacagctagccagccagccagccaactgggcgggggcacccgggcaggggtgccagatacagtattgtatctggcaacctcccggggcgctcagtgtggttttcccacccgggagtctggaagggtctcccgcagcccgcaggagacgcagcgctccccgctcagggggagcaggaggacagctggccgctttcgggagccccaggcgcgaagcggcctctctccgcctcaggctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccaggtacttccagtctgattccaggaatgcctcaacaggttcctccttcagagtctgctggccagattgaccagaacttcaaaatgccacaagaaataaattacaaggaggcttttcagcatgaagttgctcatgaaatgcctcctggctccaaatctcctttttaggttacagaaggtagatgcttctgatttacttctctcaaagctagaagccaagaaaatggccagctagaaccaagatttaaggggctgtaaaaggcaagttcagggactctccagcctactccttttctgaaaaacccttaatcatgtgaacatttgaactagttataggataaaataaactcagaataaggatttaaaataagtaaccaagtggctgtgactttttcctcttgttttatcaacgttttggagactacacaatgaaaacacatctgttggggtgatcagacccaacacccggccatgggggctacaaagtccagccgagtcaaaggaaagagaaaagacaagtcaagagagaaagtgggaccagggggccaatgctagtatggaggctgtgaagtccccaagctctggaagcccacactatttgttggtgatcaaacaaagaaacaggtgatgaggatgtgggagttgaaagaaagtggtgtatcaagcgaatgaactacagctgtgagggtttagcattttctttgaaacatatggctacttgagataatgggagtgctagaagcaaggagccagcaagtctggacacattacaaaggccacaaggggttttatcctggaccccggacatgttccaagccctgcctcaacttttctcccaacactaagctttcctcccaacacacatccatctcgtgtgttcatgtcttaacttttgcttcacttcacagtcaggcctctccgagtattttttacacatatcctggagtctacctatgtcactgatagcagatatttttcttcaacatatattatcaatgttttaatacttttcttcaattttagtaactggtaaaatacatgtaagatgtaccatcttaaccatttttaagtgtacagatcagttgtattaagtagattcatattcttgtgcaaccatcatcaccatccggctgcaaaactctttcatcttgcaaaactgaaactctacacccattaaaaaataactcgccatttctctctctccccagcccctggcaaccaccattctttctgtctctgtgatttagattactctgtaagtatgttgtataaatagactcatacaatgtt

SEQ ID NO: 128079 - DNA, 439 bp, Homo sapiens
  Payload ID: 5080
  Gene Symbol: DYDC2
  Gene Name: DPY30 domain containing 2
  ENST ID: ENST00000411538
  CDS Start-End: 63-439
cgcgcctcaggagccagtgtaggcgccgcaaagcggaaggggcgcgcggataggctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccaggtacttc

SEQ ID NO: 128080 - DNA, 1173 bp, Homo sapiens
  Payload ID: 5080
  Gene Symbol: DYDC2
  Gene Name: DPY30 domain containing 2
  Uniprot ID: Q96IM9
  ENST ID: ENST00000444807
  CDS Start-End: 310-843
aaacagctgcctccagcgtgaagaaggtgccacagagatggaaggagattccttacccacacctgggagacagctagccagccagccagccaactgggcgggggcacccgggcaggggtgccagatacagtattgtatctggcaacctcccggggcgctcagtgtggttttcccacccgggagtctggaagggtctcccgcagcccgcaggagacgcagcgctccccgctcagggggagcaggaggacagctggccgctttcgggagccccaggcgcgaagcggcctctctccgcctcaggctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccaggtacttccagtctgattccaggaatgcctcaacaggttcctccttcagagtctgctggccagattgaccagaacttcaaaatgccacaagaaataaattacaaggaggcttttcagcatgaagttgctcatgaaatgcctcctggctccaaatctcctttttaggttacagaaggtagatgcttctgatttacttctctcaaagctagaagccaagaaaatggccagctagaaccaagatttaaggggctgtaaaaggcaagttcagggactctccagcctactccttttctgaaaaacccttaatcatgtgaacatttgaactagttataggataaaataaactcagaataaggatttaaaataagtaaccaagtggctgtgactttttcctcttgttttatcaacgttttggagactacacaatgaaaacacatctgttggggtgatcagacccaacacccggccatgggggctacaaagtccagccgagtc

SEQ ID NO: 128081 - DNA, 1723 bp, Homo sapiens
  Payload ID: 5080
  Gene Symbol: DYDC2
  Gene Name: DPY30 domain containing 2
  Uniprot ID: Q96IM9
  ENST ID: ENST00000616870
  CDS Start-End: 68-601
gagctcgcgcctcaggagccagtgtaggcgccgcaaagcggaaggggcgcgcggataggctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccaggtacttccagtctgattccaggaatgcctcaacaggttcctccttcagagtctgctggccagattgaccagaacttcaaaatgccacaagaaataaattacaaggaggcttttcagcatgaagttgctcatgaaatgcctcctggctccaaatctcctttttaggttacagaaggtagatgcttctgatttacttctctcaaagctagaagccaagaaaatggccagctagaaccaagatttaaggggctgtaaaaggcaagttcagggactctccagcctactccttttctgaaaaacccttaatcatgtgaacatttgaactagttataggataaaataaactcagaataaggatttaaaataagtaaccaagtggctgtgactttttcctcttgttttatcaacgttttggagactacacaatgaaaacacatctgttggggtgatcagacccaacacccggccatgggggctacaaagtccagccgagtcaaaggaaagagaaaagacaagtcaagagagaaagtgggaccagggggccaatgctagtatggaggctgtgaagtccccaagctctggaagcccacactatttgttggtgatcaaacaaagaaacaggtgatgaggatgtgggagttgaaagaaagtggtgtatcaagcgaatgaactacagctgtgagggtttagcattttctttgaaacatatggctacttgagataatgggagtgctagaagcaaggagccagcaagtctggacacattacaaaggccacaaggggttttatcctggaccccggacatgttccaagccctgcctcaacttttctcccaacactaagctttcctcccaacacacatccatctcgtgtgttcatgtcttaacttttgcttcacttcacagtcaggcctctccgagtattttttacacatatcctggagtctacctatgtcactgatagcagatatttttcttcaacatatattatcaatgttttaatacttttcttcaattttagtaactggtaaaatacatgtaagatgtaccatcttaaccatttttaagtgtacagatcagttgtattaagtagattcatattcttgtgcaaccatcatcaccatccggctgcaaaactctttcatcttgcaaaactgaaactctacacccattaaaaaataactcgccatttctctctctccccagcccctggcaaccaccattctttctgtctctgtgatttagattactctgtaagtatgttgtataaatagactcatacaatgtt

SEQ ID NO: 128082 - DNA, 631 bp, Homo sapiens
  Payload ID: 5081
  Gene Symbol: DPY30
  Gene Name: dpy-30 histone methyltransferase complex regulatory subunit
  Uniprot ID: Q9C005
  ENST ID: ENST00000295066
  CDS Start-End: 250-549
acggccggagctgtttgtgctgggagctggtggcgcggtgcagggctcttaagaacgaacggcttgggcgcgggtaatcagctccctttcccccactttctcacttattctaggtacttgggactgtcgtagagtttccagaccccatgtaggcgcccagtcgtggactgtcccactctgctgctctactgctcgtggtgctcccgcgcccagactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagaccaccaaatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattcc

SEQ ID NO: 128083 - DNA, 708 bp, Homo sapiens
  Payload ID: 5081
  Gene Symbol: DPY30
  Gene Name: dpy-30 histone methyltransferase complex regulatory subunit
  Uniprot ID: Q9C005
  ENST ID: ENST00000342166
  CDS Start-End: 117-416
gtcacttacggccggagctgtttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagaccaccaaatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattccctctttttggatgtataagaaccttccggacaacagaacctatttctggaattgcagaagataacatatttcccttattttgatttaatcaccataaaccatacctatttaatgagtgtattctgtgcaatttttttctcagattgtctttaactttgtttttaaaatgaccttcaaaataaactgtcaaaacaccattattttaaagta

SEQ ID NO: 128084 - DNA, 989 bp, Homo sapiens
  Payload ID: 5082
  Gene Symbol: DRAP1
  Gene Name: DR1-associated protein 1 (negative cofactor 2 alpha)
  Uniprot ID: Q14919
  ENST ID: ENST00000312515
  CDS Start-End: 246-863
gggcgggagcggcggtccagactggggagggacgcgcaccggccaggaggcttcaagaggagggcactagggccctgcgagcggcgtcttaaccggcggcgctaggactccgcgggaaacggcgggggcggagcgggcggcaccaggacccaggggaaccgcgacgggcgggcggcgagcaggcccgggagccgggaggctgcgggcggcggcgctggacccgacgcggcgagagaggccccgagatgccgagcaagaagaagaagtacaacgcgcggttcccgccggcgcggatcaagaagatcatgcagacggacgaagagattgggaaggtggcggcggcggtgcctgtcatcatctcccgggcgctcgagctcttcctagagtcgctgttgaagaaggcctgccaggtgacccagtcgcggaacgcgaagaccatgaccacatcccacctgaagcagtgcatcgagctggagcagcagtttgacttcttgaaggacctggtggcatctgttcccgacatgcagggggacggggaagacaaccacatggatggggacaagggcgcccgcaggggccggaagccaggcagcggcggccggaagaacggtgggatgggaacgaaaagcaaggacaagaagctgtccgggacagactcggagcaggaggatgaatctgaggacacagatactgatggggaagaggagacatcacaacccccaccccaggccagccacccctctgcccactttcagagccccccgacacccttcctgcccttcgcctctactctgcctttgcccccagcgcccccgggcccctcagcacctgatgaagaggacgaagaagattacgactcctagcgccttctgccccccagaccatagccccttttagttggttttagttgctctggggggaggagagaaggtagagctgttcttaaatttattaaaaaaaaaaataaaagggaatctcagtgtctgttc

SEQ ID NO: 128085 - DNA, 819 bp, Homo sapiens
  Payload ID: 5082
  Gene Symbol: DRAP1
  Gene Name: DR1-associated protein 1 (negative cofactor 2 alpha)
  ENST ID: ENST00000376991
  CDS Start-End: 168-806
gagcggcgtcttaaccggcggcgctaggactccgcgggaaacggcgggggcggagcgggcggcaccaggacccaggggaaccgcgacgggcgggcggcgagcaggcccgggagccgggaggctgcgggcggcggcgctggacccgacgcggcgagagaggccccgagatgccgagcaagaagaagaagtacaacgcgcggttcccgccggcgcggatcaagaagatcatgcagacggacgaagagattgggaaggtggcggcggcggtgcctgtcatcatctcccgggcgctcgagctcttcctagagtcgctgttgaagaaggcctgccaggtgacccagtcgcggaacgcgaagaccatgaccacatcccacctgaagcagtgcatcgagctggagcagcagtttgacttcttgaaggacctggtggcatctgttcccgacatgcagggggacggggaagacaaccacatggatggggacaagggcgcccgcagatggactgtaccttcccaaaggggccggaagccaggcagcggcggccggaagaacggtgggatgggaacgaaaagcaaggacaagaagctgtccgggacagactcggagcaggaggatgaatctgaggacacagatactgatggggaagaggagacatcacaacccccaccccaggccagccacccctctgcccactttcagagccccccgacacccttcctgcccttcgcctctactctgcctttgcccccagcgcccccgggcccctcagcacctgatgaagaggacgaagaagattacgactcctagcgccttctgcccc

SEQ ID NO: 128086 - DNA, 751 bp, Homo sapiens
  Payload ID: 5082
  Gene Symbol: DRAP1
  Gene Name: DR1-associated protein 1 (negative cofactor 2 alpha)
  ENST ID: ENST00000532933
  CDS Start-End: 75-632
gcacccccttaggggacggtggcgacggggtctgaactctgctcccccacccgcaggcgcggatcaagaagatcatgcagacggacgaagagattgggaaggtggcggcggcggtgcctgtcatcatctcccgggcgctcgagctcttcctagagtcgctgttgaagaaggcctgccaggtgacccagtcgcggaacgcgaagaccatgaccacatcccacctgaagcagtgcatcgagctggagcagcagtttgacttcttgaaggacctggtggcatctgttcccgacatgcagggggacggggaagacaaccacatggatggggacaagggcgcccgcaggggccggaagccaggcagcggcggccggaagaacggtgggatgggaacgaaaagcaaggacaagaagctgtccgggacagactcggagcaggaggatgaatctgaggacacagatactgatggggaagaggagacatcacaacccccaccccaggccagccacccctctgcccactttcagagccccccgacacccttcctgcccttcgcctctactctgcctttgcccccagcgcccccgggcccctcagcacctgatgaagaggacgaagaagattacgactcctagcgccttctgccccccagaccatagccccttttagttggttttagttgctctggggggaggagagaaggtagagctgttcttaaatttattaaaaaaaaaaataaaagggaatctcagtg

SEQ ID NO: 128087 - DNA, 695 bp, Homo sapiens
  Payload ID: 5082
  Gene Symbol: DRAP1
  Gene Name: DR1-associated protein 1 (negative cofactor 2 alpha)
  ENST ID: ENST00000525501
  CDS Start-End: 229-695
cagactggggagggacgcgcaccggccaggaggcttcaagaggagggcactagggccctgcgagcggcgtcttaaccggcggcgctaggactccgcgggaaacggcgggggcggagcgggcggcaccaggacccaggggaaccgcgacgggcgggcggcgagcaggcccgggagccgggaggctgcgggcggcggcgctggacccgacgcggcgagagaggccccgagatgccgagcaagaagaagaagtacaacgcgcggttcccgccggcgcggatcaagaagatcatgcagacggacgaagagattgggaaggtggcggcggcggtgcctgtcatcatctcccgggcgctcgagctcttcctagagtcgctgttgaagaaggcctgccagggggacggggaagacaaccacatggatggggacaagggcgcccgcaggggccggaagccaggcagcggcggccggaagaacggtgggatgggaacgaaaagcaaggacaagaagctgtccgggacagactcggagcaggaggatgaatctgaggacacagatactgatggggaagaggagacatcacaacccccaccccaggccagccacccctctgcccactttcagagccccccgacacccttcctgcccttcgcctctactctgcctttgcccccagcgcccccgggcccctcagcacc

SEQ ID NO: 128088 - DNA, 581 bp, Homo sapiens
  Payload ID: 5082
  Gene Symbol: DRAP1
  Gene Name: DR1-associated protein 1 (negative cofactor 2 alpha)
  ENST ID: ENST00000527119
  CDS Start-End: 1-486
atgccgagcaagaagaagaagtacaacgcgcggttcccgccgtcgcggaacgcgaagaccatgaccacatcccacctgaagcagtgcatcgagctggagcagcagtttgacttcttgaaggacctggtggcatctgttcccgacatgcagggggacggggaagacaaccacatggatggggacaagggcgcccgcaggggccggaagccaggcagcggcggccggaagaacggtgggatgggaacgaaaagcaaggacaagaagctgtccgggacagactcggagcaggaggatgaatctgaggacacagatactgatggggaagaggagacatcacaacccccaccccaggccagccacccctctgcccactttcagagccccccgacacccttcctgcccttcgcctctactctgcctttgcccccagcgcccccgggcccctcagcacctgatgaagaggacgaagaagattacgactcctagcgccttctgccccccagaccatagccccttttagttggttttagttgctctggggggaggagagaaggtagagctgttcttaaatttattaaaaa

SEQ ID NO: 128089 - DNA, 3072 bp, Homo sapiens
  Payload ID: 5083
  Gene Symbol: DBN1
  Gene Name: drebrin 1
  Uniprot ID: Q16643
  ENST ID: ENST00000292385
  CDS Start-End: 611-2566
ggcggccggacgcggcccggaggcgcggggtcccgatgtggggcccggggccgcgtggccctgcgggagcccatcccccaccctaccccccgggcccgggggacaggtgtgcacggggcggccaagggcaccttcgccaccttcgagcgggcgaggtccgggcggggacggggcggggaccgagctagcggagccagcgcagcctgcccggctcagcccggcccggccacagcacaaaggaaagcgagggcgggggaggagcggagcgggctgggggccgggcgccccgcccaccggggggcctctcggagtgggccgccctccccccgaaacctgggctggagtgaggtggaaggatgtttgctgccacatggcgaccgcgaagtgactcccttaccgccgcgggtcgcggaggaggcagggggaaggtgcccatctggttcctaggcctcctctccctgctggcagatgggaacaggttcttcttgaggaaactgaggcaaagaggagggcaggtctgagggaccccgcttgggctggcctcacccgcacactgggagggcagccaggtggggactctgacctgggggcttctggaggagaggatgagatggctgggcatccatggcatggtactgcagcactggccagcagccaggcctggagggatggacgcgagagacaagctctcgtgtcctgcagggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcggagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggaggaaacagcagactttagaagcggaagaggccaagaggcggttgaaggagcagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccaggcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggagatccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagtccctggctgccccccagaccccaactctgccctcagcccttgaggagctggagcaagagcaggagccggagccccacctgctaaccaatggcgagaccacccagaaggaggggacccaggccagtgaggggtacttcagtcaatcacaggaggaggagtttgcccaatcggaagagctctgtgccaaggctccgcctcctgtgttctacaacaagcctccagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctgg

SEQ ID NO: 128090 - DNA, 2995 bp, Homo sapiens
  Payload ID: 5083
  Gene Symbol: DBN1
  Gene Name: drebrin 1
  Uniprot ID: Q16643
  ENST ID: ENST00000309007
  CDS Start-End: 221-2170
gggcggcgctaggaccgagcgagcggagggagcgagccgggcggagccagcgccccccgccccccgccggccggctcccctcccccggccgctggctcgctcggctcgcgacgctgcagaggctccgaggcggcggcggcgactccctctttccctccctcctcctccgtccgcccgtccgtccgcgcgtctgtccgttcggcccggtccggcccgaagcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcggagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggaggaaacagcagactttagaagcggaagaggccaagaggcggttgaaggagcagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccaggcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggagatccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagtccctggctgccccccagaccccaactctgccctcagcccttgaggagctggagcaagagcaggagccggagccccacctgctaaccaatggcgagaccacccagaaggaggggacccaggccagtgaggggtacttcagtcaatcacaggaggaggagtttgcccaatcggaagagctctgtgccaaggctccgcctcctgtgttctacaacaagcctccagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctgggaccccctccccgcccttcttttgaccccttcctgtctggcccaaaggaagtagcaggcccagctggggcccctcggctaccccccgtctcctgccgggcaggtcccaggttggaggccctaggcgcggttcaggtcagggctatggatggggcccaggggctttggtggcccctccccaactccttcctctttgcttgggttcctttttcacgtttagtaactgttttttttttttttttttttttttttttggaaagcacaaacttctgtaacgggtcgtgctcatgtctgttaataaagaaatccagatcccttcg

SEQ ID NO: 128091 - DNA, 2701 bp, Homo sapiens
  Payload ID: 5083
  Gene Symbol: DBN1
  Gene Name: drebrin 1
  Uniprot ID: Q16643
  ENST ID: ENST00000393565
  CDS Start-End: 117-2204
ctcgcgacgctgcagaggctccgaggcggcggcggcgactccctctttccctccctcctcctccgtccgcccgtccgtccgcgcgtctgtccgttcggcccggtccggcccgaagcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcggagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggaggaaacagcagactttagaagcggaagaggccaagaggcggttgaaggagcagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccaggtcgtccgtactgccctttcataaaggcatcggacagtgggccttcctcctcctcctcttcctcctcctcccctccacggactccctttccctatatcacctgccaccgcaccccaaacctctcttcctccctcccatgcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggagatccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagtccctggctgccccccagaccccaactctgccctcagcccttgaggagctggagcaagagcaggagccggagccccacctgctaaccaatggcgagaccacccagaaggaggggacccaggccagtgaggggtacttcagtcaatcacaggaggaggagtttgcccaatcggaagagctctgtgccaaggctccgcctcctgtgttctacaacaagcctccagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctg

SEQ ID NO: 128092 - DNA, 456 bp, Homo sapiens
  Payload ID: 5083
  Gene Symbol: DBN1
  Gene Name: drebrin 1
  ENST ID: ENST00000514833
  CDS Start-End: 85-456
aaaggatctcctagctggccccatctgagagggcacaggcgtggaggggaggagaggcctggaatggagggataatgagctggcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcggagttcttccagggtgtcgacgtgatcgtgaacgccagcagcgtggaagacata

SEQ ID NO: 128093 - DNA, 1044 bp, Homo sapiens
  Payload ID: 5083
  Gene Symbol: DBN1
  Gene Name: drebrin 1
  ENST ID: ENST00000477391
  CDS Start-End: 93-1044
ggcggcggcggcgactccctctttccctccctcctcctccgtccgcccgtccgtccgcgcgtctgtccgttcggcccggtccggcccgaagcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcggagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggaggaaacagcagactttagaagcggaagaggccaagaggcggttgaaggagcagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccag

SEQ ID NO: 128094 - DNA, 1878 bp, Homo sapiens
  Payload ID: 5083
  Gene Symbol: DBN1
  Gene Name: drebrin 1
  ENST ID: ENST00000512501
  CDS Start-End: 216-1391
gtccttccccaggaagcagtggccacgctgcagctggaaaccagagggcctggcccccgggtggggagcaggcatttgggagggaggccagtctcccatgctgaggcttggaggtgggaacgggtgtgcctgttctgggaactgactgcgtcgtgctgaggacttgatgtctacatctcacaggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccaggcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggagatccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagtccctggctgccccccagaccccaactctgccctcagcccttgaggagctggagcaagagcaggagccggagccccacctgctaaccaatggcgagaccacccagaaggaggggacccaggtgcggcagggactgcctggtgggagggatgggagggagtgggggctgagcagggtgctggccctgcattcctcatgcttgcaccagtacccccttctctgtgacccacattatttgaggggaagtccatcccaccctccctccctgggccggctctgcttttgttcccaaggcaggcatccttgtttccctggcaaccactgatggaatcattggttgctggggaaacgggctcaggcctgataggtcagccccagtcctgctgggtggggccaagtgacctgatgctttcccctgcaggccagtgaggggtacttcagtcaatcacaggaggaggagtttgcccaatcggaagagctctgtgccaaggctccgcctcctgtgttctacaacaagcctccaggtagtactgggctggatgatggggaggaatttgggtgcgggggctggatttgagtgtgggtagccaccccaccactacccaccgctcacagaggctggggacacaagcggtctgctaggtccctaactcctctccctttctaacgccacagagatcgacatcacatgctgggatgcagacccagttccagaagaggaggagggcttcgagggtggtgattagcggtggcgccagccctaggctacccttgccaaggccgcccacctgcatcagcctctggccagacgg

SEQ ID NO: 128095 - DNA, 477 bp, Homo sapiens
  Payload ID: 5083
  Gene Symbol: DBN1
  Gene Name: drebrin 1
  ENST ID: ENST00000506117
  CDS Start-End: 199-477
gaaacctgggctggagtgaggtggaaggatgtttgctgccacatggcgaccgcgaagtgactcccttaccgccgcgggtcgcggaggaggcagggggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcggagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgca

SEQ ID NO: 128096 - DNA, 1447 bp, Homo sapiens
  Payload ID: 5084
  Gene Symbol: DBNL
  Gene Name: drebrin-like
  ENST ID: ENST00000411855
  CDS Start-End: 19-207
gagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagagcaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagca

SEQ ID NO: 128097 - DNA, 1854 bp, Homo sapiens
  Payload ID: 5084
  Gene Symbol: DBNL
  Gene Name: drebrin-like
  ENST ID: ENST00000441840
  CDS Start-End: 53-205
cccggcccggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgctgctgctcctgctgcagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagagcaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattct

SEQ ID NO: 128098 - DNA, 897 bp, Homo sapiens
  Payload ID: 5084
  Gene Symbol: DBNL
  Gene Name: drebrin-like
  ENST ID: ENST00000452661
  CDS Start-End: 1-416
tcaagcagaaggagagggccatgtccaccacctccatctccagtcctcagcctgatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtgg

SEQ ID NO: 128099 - DNA, 9618 bp, Homo sapiens
  Payload ID: 5084
  Gene Symbol: DBNL
  Gene Name: drebrin-like
  ENST ID: ENST00000432854
  CDS Start-End: 1-1078
ggcaacagcaatgacatccgcgtggctggcacaggggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaattcccagtttggtctacacaggctcgcagctctcacctgtcctgctgtagcctgaatgctcccatgtgggaatagcaccccaccacctgcccagtgtctgcctctgctccgtgtctggggtgagcaccctcaccctgagactgtggctgatgatgatcagccaccaggaagaggctaaatgttaagatgggactgaagttggagccttcctgcgttccagttcctctaggagaggccaagggctgccctgctcccagcttcagggagcctctgcctacatgggatggcccactgtgtggcgtcaggtacctggcacccactgagcatccggggaattaggtccctcctgtgccccagagctgctaggcagactgctaggcggttgactcaaggtgttacctgctagtgcctggggtgaaggctgcatggagcccaaccttgctcctggccttcctgtgctcaggcctctccccttttcgccagggcttcctggtgcctctcccatgaagagggaacttcccctccactcccatggaagacccaggtttgggctgttgccagctttgaggccccctgtgggcttgcctgtcccaacccaagaggcagggctcaaagtgccacccgggggttgcaaggacagcagaggaccacctgccctctgcaggaagctgtccaggaagccgtgtcctgggctgtggtccttgctccccatggggagagctgggtcacttggcctcttctaactggccccaagcacgccaattctggagcatggttactaagtggctctgaagcttcagggtcaccacaggcttgtcctgactgcaaactcatggagtggttgcagccctggctcagtgtcctgatgactaggtgtgggtactaggctcctgcccctggtgacacacgtatggagtgggggagggtgggtggctgcacccctggttctggagtccccacagctgatggcggtgtgagcctggcatgcacggctgcgctggactccaggctgttgggggaggtgcctttattgcccaagcccacccctcacttggccttgccctgggcagccacagcctccatggccttccgcaccgtttcctcatcacccaggaactgcatgggcttggtgggcttcagctccttgttcagctcatacacaatggggatccccgtgggcaggttcagctccatgatcgcctggtctgacatccctatgccggaaggaataggtgtccttagcccctctgtccccagcctgtttacacagcagacactatgtgacctttatggtccacagagccagttcccctggcaccaattccttcccagccctgagaacgaggccacagaaatgttgccaaaggtcaaggagtaactgagttagaccaagcagcctacagaaatagcccagtggtgaaaaaaatggggacttcagccccacccaagtggctgtgatctgtggtggtgctgtccatagttccctcagcccagtgtgactccagccagactgaagttgagggtcaggaagggacactcaccctttgttttttttttttcttttctttttctttttcttttttttgagatggagttttactcctcttgcccaggctggagtgcagtggcacgatcttggctcactgcaacctccatctcctgggttgaagtgattctgcctcagcctcccaagtagctgggattacaggtgagcgccaccacacccggctaattttgtatttttagtagaaacgggttttaccatgttggtcaggctggtctcaaactcctgacctcaggtgatctgcctgcctcagcctcccaaagtgctgggattacaggagtgagccaccgtgcccagcaccctttggtttctaaagtgctctaaattctagacatcctgaacagaggagcaagtgcggaatggagctggaggagggacagggaggccgagcctggtcgaaacctgaccctgcctgcctcctgcagcccctgagctgggaatagcagctcgacctttgatgttcgcgccactccacccctgctccgtgcaggagggtttaagaaaatgttctctggggagtcagagtgaaatccctcatattcaccaccaaaagtgcgtcccctttccccaaaccaggctgtgggagggtcatggggctgcatgaagtctccggaagggagaggaggcaggtggtccttccctctgcctggccccagtgccaggtgccaggtgtccgtgtttggagcgggcaggcttggggctggctgggtctccggggcctgccggtctgggtgctctggccaactgcccaacggccctaggagcaggaggtctggggcacacccttctagcctttccaggactcaacaagctttaaggtcattcagatgctaatttagactgcccttgtgtcagaatactaaggtgggaggcggagcggaggtgccagtcactctgggcgaggccttactgcgcccatgcatcccgggcccatttgtcagcccttgctcttcagtgggagcccagctgcaagcccagagtctggccactccatagtcctgcacccctcttttgattggtctttcctttgcccagagaggggctccagagggagataggtggtgaagctcatgcagggattctgaggacctgatgggggagggccctgcgaggggtccaagcctacatcaagaggaattcagtaccagggggagctccccaccaccccggaaaagggagaggcccagagatggaggtggcttgtccagggccccacagtaagttgggatttggagccagatgctctaagcccagcccttccgtttcctagctgggtgtcccttggcagatgccacctttggagcctgccccacctcgggacacagcgagcttcgagtgcagtcagcccctgtggagtgtgtcccagttacacagaaatggggaaaatttcacaaaactaaaaaatggcttctcagccctcctttttcagtgaatgatgtggagccccacgcctagaaagcctggtccatgggcgagagactttgctgagatgagaagccagctggggctgctgcccacccaccctgcccaggctcctgaaggtggcctcaccttccaggtgcttgacaatgccccgcaggctgttcccgtgggctgcaatgagcactcgcttgccggccttgatctggggaacaatctcctcgttccagaagggcagggcccgggcaatggtgtccttgaggctctcgcaggtggggagttccccgggcttcaggcctgcgtaccgacgctcctgggggacacaggcacgctgctttccctcccaagccagtgggcccccacccgactccccactctgcagcttcccagaggccttcccagcaaaggcagcccaccttgctaatggagttgtagtaggggtgcttctcgtccatcgggggcggcgggatgtcgaaggagcgcctccagatcttcacctgctcctccccgtgcttggcggccgtttctgccttgttgaggcctgtgaggcccccgtaatgccgctcattgaggcgccaagtgcgcaccacaggcagccacatctggtccgtgccgtccaggatggcccagagggtgcggatggcccgcttcagcactgacgtgtagcagatgtcaaactccatcttggcatccttgatggccttggctccccgcttggcctcctcggtccccttttcactcagctctgcatcgaaccagccacagaaacggttctcctggttccatgtgctctcgccgtgccggaccatcacgaggcggtgagtggccatggtggcagcagggaccacagaggactctggacggggacggctgcttcccaacactcccagctttataatagtgtcttcccagcccccacccaccccagccaactgccaatcagcattccaggcggtggcaggtgaccagtagctgagctgctgggggctgggggccaggggagtgtgcaggccaagaggctgtgcttaaaatagccccacgcatccaccagctcctggcctgggttcaggtggcatgtctataaccagctggcacccagagcccagactgagtggggctgctggtcagggatgggcgtgaagggcagaagtctgggccaggggagatggggatagcagggacagaggggctctccagggcaacgctcagtggcctatcagccattctctgctcagacagaggcacaaacaaaatcccaacccctttctcctgtgattggcagccaggctaggaggcggccctcagcaggcagaggaggagagccagaggagctggtgcagaccacagctttgtggagaggagtctggccttgtggaaggtaccaggcagcagcagcagaatgggcaagggctggggctgagccgggtttccaggacaaagggggaaagggcccctgtctttcctccggggtccctttgtcaaggtctcatccatacatgccccatgctcccaccctatctgccctcacccaagccacgctcactctcctagccgaaaccaccttgaaaaagagaaatccaagggggtttgggggcaggactgaggactgtcagaagtcttgattgttaggtaaatgctcagcttagcaggaacccacaacgtaggctgaagggtggcacggagttgagtctaggaccaagacttctgcattcaggtttgggggatgagagccaccaaggcagggaagagactatgagcaataaagtcacaattggggccctaatgaaggggccatggccagacccttgggcatgggccccatccagggcctcccatttcctcccaccccagtgaccacactgtcacctgcgacacttctgataacaggagcgggtaggtgagaggccagcagagggaccaccactctgagacttggatctgagtgtgcaagaaaccctcgacaggcctccctccatccctgctggcctacctggggaggggctcctggcttggggcctgtgaagctaaggctctgtacccaaaggttggcagacaagtcccagtgggcaaagtcctgtcggctgccaggacccccaaggctggcaggtggaacccatccctcctagcagtgccatgcgcaggtctcactgttccacactgatcctgattgaagccacatctcctcatctgcttttgtccctttgaccaagagttgattcactagcccaactaaacatgactgaggaccaggctctggcagtcccacaggggccagacatgaagcccatatttcagtggaggagggatcgtaccagcagctaaacatgcctaccgtagatagcaccagatgctaggaaggaaggaccataatgtactgggagagatgggaaaggagaggccggggacagccctgaggtgacatgtgagtggaaagagcggagtgcaaaggcctcagctatgatgagtcctacagggagagcaattcaggtagaggggttggcaaagacccaagccctacagaaagcaaacaagctggggcagcgaccatcaggggcacatggcagagaggtgggctttgtgtcccaacacagtgggaatcactggagactttgaagcatggtcatattttcaagtcacttgcagctgtgtaggagtggaagtagaagctgagtaccctgcaggtctcggcagctttgatgagaacaaggccgcttagccagggctgggtgcagaagcagtggcaaggatcccccagacctgggagacctcactgccaaccaagcaggaggtgtcaaaaaggaaaggggagcccaaagaagggctggacttcggggaagcaagcccctgcttctgacccttggctccggcttgactttcctttgattcatttgacaagtagttgctggcctctgcagtgtgccagagctttcttggaggggtacaggggtaggaaaaccaaaagccaccctcagggcctccatccaggaaggcatagcatggtgggcggcgaggaaggctgctgagtcaacaaggtggtcccaggaaggtggagggagcatcttcccatgtctctcccactgacagccaccaatcctggacagatgcaggagcagctgtcagtagacagataagaaaaggagatcagattcaaagttccgcagagaagtggtgaggtaacaagtattgcctagcctggacacacaggcggcttgaaacctcaagtgcaccaacagaaagagctccaggaagaatcagaggagtgggatgtgaagcccctcgaagtcagtgagttgggggaatccctccaatttttcttttcttctctaccccagctcctgggcagtaacatggaggtggcagtggtggcacagtgacggtagtgtgagctgggtacgcacttgaaacctgagagggtaacgctaccctctgtctagaggagccatggccccaaaagcatggggcaaccaccttctgcagctcctttctgcccccctgcgctgggccctggatgcagtttcagggagtatgcagcagggtaggtagggaaagagccccagatttgtggctggaggtcttggtagggatgttgcagggagctgttgtgtttcagggagagtacagagaagggagagatgaagtgagtgatccgataaagtgatatgtgaagtcattggcttgctgccaagctgcgcacagggctgaccctagatgcacattgcaggtcccagactgaccggtgtagatacaggactaatatgactagtagtgcaaacactttaaacagtcaacattctgcttaggatttaaacaaggtccagagtctcaacataatatttaaaatatccaggttatccaaaataacccagtgtatgaaaaccaggaaaatcttaacatgggagaaaagaagatgatcaatacatgcccatcctgagatgattcaactattggaatgatcagatacagacttcaaagcagctatttataaccagccttcagaaagtattggtgaatattcttaaacagaatggaaatgacaaagcatggagtccataaattagatgatagtttggaaaaagatataaacttacaaaccaagaagctcagtgaaccacacaactggataaattaacaacaaaagtccaagcttagacacatcataaagaaacttctgaaaactaaagaccaagaaaaataagatcagccagagaaaaacgatacatttcattcaggtgaacaattctttgaaagactggatcttcaccagaaactatagaggccagaaagaagtggaacatttttagttttgaaataactgtcacccaagaattctatatccagtaaaaatttctattttactggaataaaagaatgaaataaagacattctcaaatgaaggcaagctgaggaaattcataaccaaagaatctgctttaaaaaaatgttaaaccaagttcttcagacagaagagattactgggggcaattcaaaactttgggaatgcaggaagaacatcataaatggcaaaagtccacataaatatgaaactattctttacttctttaagagttatgtgatggttgaattaagtcatgatactgtctgatggaggcttcagtgtatacagatgtaagacaactagaacatgaggggagaagggtgaagggacctagatggtagtgaggtttctacatgctacttgaaatggcaaaacattaatctaaattgactgtaagagtatgtgtatttggccgggcagg

SEQ ID NO: 128100 - DNA, 1622 bp, Homo sapiens
  Payload ID: 5084
  Gene Symbol: DBNL
  Gene Name: drebrin-like
  ENST ID: ENST00000429716
  CDS Start-End: 31-294
agcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgttta

SEQ ID NO: 128101 - DNA, 662 bp, Homo sapiens
  Payload ID: 5084
  Gene Symbol: DBNL
  Gene Name: drebrin-like
  ENST ID: ENST00000458579
  CDS Start-End: 64-147
caaaggggcggcccggcccggcccggaagctacagcagcggcgcggagactgcggggcgggccatggcggcgaacctgagccggaacgggccagcgctgcaagaggcctacgtgcgggtggtcaccgagaagtccccgaccgactgagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagatggtcacactgaggctcgggtaagttaagccacaaggctaatgatcgactggctctggtgcccgtctttggccatgtgcctaaaactcagtcctgggcaggg

SEQ ID NO: 128102 - DNA, 1513 bp, Homo sapiens
  Payload ID: 5084
  Gene Symbol: DBNL
  Gene Name: drebrin-like
  ENST ID: ENST00000452943
  CDS Start-End: 37-1257
agctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagagcaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgag

SEQ ID NO: 128103 - DNA, 561 bp, Homo sapiens
  Payload ID: 5084
  Gene Symbol: DBNL
  Gene Name: drebrin-like
  ENST ID: ENST00000439815
  CDS Start-End: 37-132
agctacagcagcggcgcggagactgcggggcgggccatggcggcgaacctgagccggaacgggccagcgctgcaagaggcctacgtgcgggtggtcaccgagaagtccccgaccgactgggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagagcaggacgtgggagcagcagcaagaagtggtttcaaggaaccgaaatgagcaggtaagatgggggt

SEQ ID NO: 128104 - DNA, 1808 bp, Homo sapiens
  Payload ID: 5084
  Gene Symbol: DBNL
  Gene Name: drebrin-like
  Uniprot ID: Q9UJU6
  ENST ID: ENST00000448521
  CDS Start-End: 99-1391
gtttccggttgtcggaggcgaggcttgtcggctgtcaaaggggcggcccggcccggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatg

SEQ ID NO: 128105 - DNA, 1415 bp, Homo sapiens
  Payload ID: 5084
  Gene Symbol: DBNL
  Gene Name: drebrin-like
  Uniprot ID: Q9UJU6
  ENST ID: ENST00000440166
  CDS Start-End: 203-1186
aaaggggcggcccggcccggcccggaagctacagcagcggcgcggagactgcggggcgggccatggcggcgaacctgagccggaacgggccagcgctgcaagaggcctacgtgcgggtggtcaccgagaagtccccgaccgactgacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagctt

SEQ ID NO: 128106 - DNA, 878 bp, Homo sapiens
  Payload ID: 5084
  Gene Symbol: DBNL
  Gene Name: drebrin-like
  ENST ID: ENST00000441904
  CDS Start-End: 22-168
gcggagactgcggggcgggccatggcggcgaacctgagccggaacgggccagcgctgcaagaggcctacgtgcgggtggtcaccgagaagtccccgaccgactggtgggcggcgagacgggccagggtcgggccaggggctgcctcagggggctctctttacctatgaaggcaacagcaatgacatccgcgtggctggcacaggggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggccc

SEQ ID NO: 128107 - DNA, 1241 bp, Homo sapiens
  Payload ID: 5084
  Gene Symbol: DBNL
  Gene Name: drebrin-like
  Uniprot ID: Q9UJU6
  ENST ID: ENST00000456905
  CDS Start-End: 66-1214
gtcaaaggggcggcccggcccggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagagcaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccc

SEQ ID NO: 128108 - DNA, 2068 bp, Homo sapiens
  Payload ID: 5084
  Gene Symbol: DBNL
  Gene Name: drebrin-like
  Uniprot ID: Q9UJU6
  ENST ID: ENST00000468694
  CDS Start-End: 28-1347
agcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagagcaggacgtgggagcagcagcaagaagtggtttcaaggaaccgaaatgagcaggggtcaacatgtgcttccctccaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggc

SEQ ID NO: 128109 - DNA, 2004 bp, Homo sapiens
  Payload ID: 5084
  Gene Symbol: DBNL
  Gene Name: drebrin-like
  Uniprot ID: Q9UJU6
  ENST ID: ENST00000490734
  CDS Start-End: 196-1206
gtttccggttgtcggaggcgaggcttgtcggctgtcaaaggggcggcccggcccggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagagcaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacg

SEQ ID NO: 128110 - DNA, 693 bp, Homo sapiens
  Payload ID: 5084
  Gene Symbol: DBNL
  Gene Name: drebrin-like
  ENST ID: ENST00000464762
  CDS Start-End: 37-423
agctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaaggtaaggccagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtga

SEQ ID NO: 128111 - DNA, 553 bp, Homo sapiens
  Payload ID: 5084
  Gene Symbol: DBNL
  Gene Name: drebrin-like
  ENST ID: ENST00000485932
  CDS Start-End: 33-155
acagcagcggcgcggagactgcggggcgggccatggcggcgaacctgagccggaacgggccagcgctgcaagaggcctacgtgcgggtggtcaccgagaagtccccgaccgactggtgggcggcgagacgggccaggggctctctttacctatgaaggcaacagcaatgacatccgcgtggctggcacaggggggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggc

SEQ ID NO: 128112 - DNA, 1401 bp, Homo sapiens
  Payload ID: 5084
  Gene Symbol: DBNL
  Gene Name: drebrin-like
  ENST ID: ENST00000498733
  CDS Start-End: 37-183
agctacagcagcggcgcggagactgcggggcgggccatggcggcgaacctgagccggaacgggccagcgctgcaagaggcctacgtgcgggtggtcaccgagaagtccccgaccgactggtgggcggcgagacgggccagggtcgggccaggggctgcctcagggggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagagcaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgccctt

SEQ ID NO: 128113 - DNA, 2117 bp, Homo sapiens
  Payload ID: 5084
  Gene Symbol: DBNL
  Gene Name: drebrin-like
  Uniprot ID: Q9UJU6
  ENST ID: ENST00000494774
  CDS Start-End: 22-1317
gcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagagcaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaa

SEQ ID NO: 128114 - DNA, 5102 bp, Homo sapiens
  Payload ID: 5085
  Gene Symbol: DROSHA
  Gene Name: drosha, ribonuclease type III
  Uniprot ID: Q9NRR4
  ENST ID: ENST00000344624
  CDS Start-End: 48-4172
gagcttatattctctgtggaagatgtgacatatccaggcggaacatcatgatgcagggaaacacatgtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagagagcgagaacgggagagacacaggcatcgagacaaccgaagatcaccatctctggaaaggtcctacaaaaaagagtataagagatctggaaggagttacggtttatcggttgttcctgaacctgctggatgcacaccagaattacctggggagattattaaaaatacagattcttgggccccacccctggagattgtgaatcatcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaatgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagacattttgactgtgctctagtaacatctatcctttttcaaatctctggatttttaagtagattgttcagctttcatccggtggctgttcatcaagttatcagctgcaaatattgaacttacctctctctaagcagtgagtgttttgtagaaggaatccgtttaacaattaattggctaatgggagaaggggaaagactgatattcaagtcatacagattctttgaatcattagaataggagagaaatcatgattctaagccaggccacactttaaaccaagtgctctcaccctggggttagtggaacctttaagaagttaatgaacagacttcaaggaagtcaaaaacctcccaatactatattcaattttctgtgtgtgtttgagatttgagagggcatggggagcaggaaggaggagggtttatagcttttatcagcctctctaagtgggccctgcagtaaaaggctaacatgacattcaaagacataacattttaaaaaaagttattccaaactaaacatcactggtttcttattaataaaggcaaaacttctttgt

SEQ ID NO: 128115 - DNA, 4991 bp, Homo sapiens
  Payload ID: 5085
  Gene Symbol: DROSHA
  Gene Name: drosha, ribonuclease type III
  Uniprot ID: Q9NRR4
  ENST ID: ENST00000442743
  CDS Start-End: 48-4061
gagcttatattctctgtggaagatgtgacatatccaggcggaacatcatgatgcagggaaacacatgtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagagagcgagaacgggagagacacaggcatcgagacaaccgaagatcaccatctctggaaaggtcctacaaaaaagagtataagagatctggaagtcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaatgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagacattttgactgtgctctagtaacatctatcctttttcaaatctctggatttttaagtagattgttcagctttcatccggtggctgttcatcaagttatcagctgcaaatattgaacttacctctctctaagcagtgagtgttttgtagaaggaatccgtttaacaattaattggctaatgggagaaggggaaagactgatattcaagtcatacagattctttgaatcattagaataggagagaaatcatgattctaagccaggccacactttaaaccaagtgctctcaccctggggttagtggaacctttaagaagttaatgaacagacttcaaggaagtcaaaaacctcccaatactatattcaattttctgtgtgtgtttgagatttgagagggcatggggagcaggaaggaggagggtttatagcttttatcagcctctctaagtgggccctgcagtaaaaggctaacatgacattcaaagacataacattttaaaaaaagttattccaaactaaacatcactggtttcttattaataaaggcaaaacttctttgt

SEQ ID NO: 128116 - DNA, 1124 bp, Homo sapiens
  Payload ID: 5085
  Gene Symbol: DROSHA
  Gene Name: drosha, ribonuclease type III
  ENST ID: ENST00000512076
  CDS Start-End: 1-1124
ctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagtcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgacca

SEQ ID NO: 128117 - DNA, 4681 bp, Homo sapiens
  Payload ID: 5085
  Gene Symbol: DROSHA
  Gene Name: drosha, ribonuclease type III
  Uniprot ID: Q9NRR4
  ENST ID: ENST00000513349
  CDS Start-End: 370-4383
gctttttaattccctcggtttcctgttccggaggcgcgggcggtgccactgtcttggtacctgcggtagtagcctggctttgctctgacggcgatctcgcggcccgagagccttttatagacagctccttcagtgtctctgtttccaaaccgcaaccgagaagagacagacggagaaaagagagttacttttccaggttgcttttcccggggatgtgaaggatacagaaatgactgtgaatcaacccatatcatcaaggagctgataatctagtggaagagttagacgtgtgcatacttcactatgatatgaggcagtctctgagcttatattctctgtggaagatgtgacatatccaggcggaacatcatgatgcagggaaacacatgtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagagagcgagaacgggagagacacaggcatcgagacaaccgaagatcaccatctctggaaaggtcctacaaaaaagagtataagagatctggaagtcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaatgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatc

SEQ ID NO: 128118 - DNA, 5305 bp, Homo sapiens
  Payload ID: 5085
  Gene Symbol: DROSHA
  Gene Name: drosha, ribonuclease type III
  Uniprot ID: Q9NRR4
  ENST ID: ENST00000511367
  CDS Start-End: 246-4370
ctgtcttggtacctgcggtagtagcctggctttgctctgacggcgatctcgcggcccgagagccttttataggttgcttttcccggggatgtgaaggatacagaaatgactgtgaatcaacccatatcatcaaggagctgataatctagtggaagagttagacgtgtgcatacttcactatgatatgaggcagtctctgagcttatattctctgtggaagatgtgacatatccaggcggaacatcatgatgcagggaaacacatgtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagagagcgagaacgggagagacacaggcatcgagacaaccgaagatcaccatctctggaaaggtcctacaaaaaagagtataagagatctggaaggagttacggtttatcggttgttcctgaacctgctggatgcacaccagaattacctggggagattattaaaaatacagattcttgggccccacccctggagattgtgaatcatcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaatgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagacattttgactgtgctctagtaacatctatcctttttcaaatctctggatttttaagtagattgttcagctttcatccggtggctgttcatcaagttatcagctgcaaatattgaacttacctctctctaagcagtgagtgttttgtagaaggaatccgtttaacaattaattggctaatgggagaaggggaaagactgatattcaagtcatacagattctttgaatcattagaataggagagaaatcatgattctaagccaggccacactttaaaccaagtgctctcaccctggggttagtggaacctttaagaagttaatgaacagacttcaaggaagtcaaaaacctcccaatactatattcaattttctgtgtgtgtttgagatttgagagggcatggggagcaggaaggaggagggtttatagcttttatcagcctctctaagtgggccctgcagtaaaaggctaacatgacattcaaagacataacattttaaaaaaagttattccaaactaaacatcactggtttcttattaataaaggcaaaacttctttgtaaaac

SEQ ID NO: 128119 - DNA, 585 bp, Homo sapiens
  Payload ID: 5085
  Gene Symbol: DROSHA
  Gene Name: drosha, ribonuclease type III
  ENST ID: ENST00000512302
  CDS Start-End: 1-585
catttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcaggagttacggtttatcggttgttcctgaacctgctggatgcacaccagaattacctggggagattattaaaaatacagattcttgggccccacccctggagattgtgaatcatcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggat

SEQ ID NO: 128120 - DNA, 860 bp, Homo sapiens
  Payload ID: 5085
  Gene Symbol: DROSHA
  Gene Name: drosha, ribonuclease type III
  ENST ID: ENST00000507438
  CDS Start-End: 257-860
gctttcgttgacgcgccaatcaccgcgcacaaggccctgcggtgggctgaagagttttccctcccttggcccagctttctcaggttgcttttcccggggatgtgaaggatacagaaatgactgtgaatcaacccatatcatcaaggagctgataatctagtggaagagttagacgtgtgcatacttcactatgatatgaggcagtctctgagcttatattctctgtggaagatgtgacatatccaggcggaacatcatgatgcagggaaacacatgtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtc

SEQ ID NO: 128121 - DNA, 1915 bp, Homo sapiens
  Payload ID: 5086
  Gene Symbol: DSN1
  Gene Name: DSN1 homolog, MIS12 kinetochore complex component
  Uniprot ID: Q9H410
  ENST ID: ENST00000373734
  CDS Start-End: 173-922
gcatgcgcccttggttggcgggagtttcggaggcggtgaccgtgacgtagaaggtggagaccgcttcaccctgatcagggagtatcggctgcgggtgcgcaaggcgtccaggagtgacctggggctgtggagagcgacccgtggccttgtgtttcagagtttaccacctaggatgacttcagtgactagatcagagatcatagatgagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttca

SEQ ID NO: 128122 - DNA, 1922 bp, Homo sapiens
  Payload ID: 5086
  Gene Symbol: DSN1
  Gene Name: DSN1 homolog, MIS12 kinetochore complex component
  ENST ID: ENST00000373740
  CDS Start-End: 75-929
gcaaggcgtccaggagtgacctggggctgtggagagcgacccgtggccttgtgtttcagagtttaccacctaggatgacttcagtgactagatcagagatcatagatgaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttca

SEQ ID NO: 128123 - DNA, 2233 bp, Homo sapiens
  Payload ID: 5086
  Gene Symbol: DSN1
  Gene Name: DSN1 homolog, MIS12 kinetochore complex component
  Uniprot ID: Q9H410
  ENST ID: ENST00000373750
  CDS Start-End: 170-1240
tgcgcccttggttggcgggagtttcggaggcggtgaccgtgacgtagaaggtggagaccgcttcaccctgatcagggagtatcggctgcgggtgcgcaaggcgtccaggagtgacctggggctgtggagagcgacccgtggccttgtgtttcagagtttaccacctaggatgacttcagtgactagatcagagatcatagatgaaaaaggaccagtgatgtctaagactcatgatcatcaattggaatcaagtctcagtcctgtggaagtgtttgctaaaacatctgcctccctggagatgaatcaaggcgtttcagaggaaagaattcaccttggctctagccctaaaaaagggggaaattgtgatctcagccaccaggaaagacttcagtcgaagtcccttcatttgtctcctcaagaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttca

SEQ ID NO: 128124 - DNA, 2441 bp, Homo sapiens
  Payload ID: 5086
  Gene Symbol: DSN1
  Gene Name: DSN1 homolog, MIS12 kinetochore complex component
  Uniprot ID: Q9H410
  ENST ID: ENST00000426836
  CDS Start-End: 374-1444
accctgatcagggagtatcggctgcgggtgcgcaaggcgtccaggagtgacctggggctgtggagagcgacccgtggccttgtgtttcaggtacggaggttccggactggacgggcgtcaggaagtcacagacttgtcctctgatgtggccccgcccgccgccgcactaatctcttcggcgtcgtacccgtcggcccagctcgacccgccgcagccccggccccgaccgtggacactgggggtccccgagggcgctgcgacctcctcccgggtgaaatgaaacccgagggcagtcccccttaccgaccccattagagacgtatctgccgtgccaggggtctaggctccagaaacagggagtttaccacctaggatgacttcagtgactagatcagagatcatagatgaaaaaggaccagtgatgtctaagactcatgatcatcaattggaatcaagtctcagtcctgtggaagtgtttgctaaaacatctgcctccctggagatgaatcaaggcgtttcagaggaaagaattcaccttggctctagccctaaaaaagggggaaattgtgatctcagccaccaggaaagacttcagtcgaagtcccttcatttgtctcctcaagaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttcatcta

SEQ ID NO: 128125 - DNA, 631 bp, Homo sapiens
  Payload ID: 5086
  Gene Symbol: DSN1
  Gene Name: DSN1 homolog, MIS12 kinetochore complex component
  ENST ID: ENST00000438549
  CDS Start-End: 207-631
agaaggtggagaccgcttcaccctgatcagggagtatcggctgcgggtgcgcaaggcgtccaggagtgacctggggctgtggagagcgacccgtggccttgtgtttcagccaccaggaaagacttcagtcgaagtcccttcatttgtctcctcaagaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccag

SEQ ID NO: 128126 - DNA, 1146 bp, Homo sapiens
  Payload ID: 5086
  Gene Symbol: DSN1
  Gene Name: DSN1 homolog, MIS12 kinetochore complex component
  ENST ID: ENST00000447406
  CDS Start-End: 422-1146
gggagtttcggaggcggtgaccgtgacgtagaaggtggagaccgcttcaccctgatcagggagtatcggctgcgggtgcgcaaggcgtccaggagtgacctggggctgtggagagcgacccgtggccttgtgtttcaggtacggaggttccggactggacgggcgtcaggaagtcacagacttgtcctctgatgtggccccgcccgccgccgcactaatctcttcggcgtcgtacccgtcggcccagctcgacccgccgcagccccggccccgaccgtggacactgggggtccccgagggcgctgcgacctcctcccgggtgaaatgaaacccgagggcagtcccccttaccgaccccattagagacgtatctgccgtgccaggggtctaggctccagaaacagggagtttaccacctaggatgacttcagtgactagatcagagatcatagatgaaaaaggaccagtgatgtctaagactcatgatcatcaattggaatcaagtctcagtcctgtggaagtgtttgctaaaacatctgcctccctggagatgaatcaaggcgtttcagaggaaagaattcaccttggctctagccctaaaaaagggggaaattgtgatctcagccaccaggaaagacttcagtcgaagtcccttcatttgtctcctcaagaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccag

SEQ ID NO: 128127 - DNA, 2129 bp, Homo sapiens
  Payload ID: 5086
  Gene Symbol: DSN1
  Gene Name: DSN1 homolog, MIS12 kinetochore complex component
  Uniprot ID: Q9H410
  ENST ID: ENST00000448110
  CDS Start-End: 114-1136
gaccgcttcaccctgatcagggagtatcggctgcgggtgcgcaaggcgtccaggagtgacctggggctgtggagagcgacccgtggccttgtgtttcagaaaaaggaccagtgatgtctaagactcatgatcatcaattggaatcaagtctcagtcctgtggaagtgtttgctaaaacatctgcctccctggagatgaatcaaggcgtttcagaggaaagaattcaccttggctctagccctaaaaaagggggaaattgtgatctcagccaccaggaaagacttcagtcgaagtcccttcatttgtctcctcaagaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagtttccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttca

SEQ ID NO: 128128 - DNA, 13776 bp, Homo sapiens
  Payload ID: 5087
  Gene Symbol: DTWD1
  Gene Name: DTW domain containing 1
  Uniprot ID: Q8N5C7
  ENST ID: ENST00000251250
  CDS Start-End: 208-1122
gttcgaggactcgcgggtgtgcagggatgcggtttaatattttcatgtgattcctaaaagaatctgaggctcaagaaaagagggcatcttaatatcctgcactttcagtcattgagggcatgatcacaaagatcaaagccatttttaggcagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgatttgaatgacagcaagtgcaaaggcacaacactgaaaaaaattatatttatagatagcacctggaaccaaacaaacaaaatattcactgatgagcgacttcaagggttgttacaagttgagttgaaaacaagaaaaacttgcttttggcgccatcaaaaaggaaagccagatactttcctttctacaattgaagccatttactactttctggtagactaccatactgatatattaaaagagaaatacagagggcaatatgacaatcttttatttttctattcttttatgtaccagttgataaagaatgccaaatgctctggagataaggaaacaggaaaacttacacattagtttttaacaagccacttatgtctttttattttgctaacattaataaacttatatttgtgctttgttttttcttaagaaataatcatatataatgcctgtaagaccatttgaaaaaattccagtttcatatatatcacttcatatttcttgaaggaaattgtatctgggggaatttttcagagatactgttgattgaaaaacttacttcagaagttatttgctcagtgaaacctcagtttcattactacattttaatatagtgtgttatgtctctgtgattagatataacatattccattagatctaattagctatttatttcaacatctttatatcttttcacctgtactcatgaccacctttagaagtaaatggggttacaatctgctggctgaaaaataggtcataagtgatttttcttgaggttagtagcaaacataggcagaactagaattagaattctggtatctagggctgtttctttaagtcctaaggttgttaaaagcagagactctggagctagactacctgaatctaaatctcagcctttctgcttatcagccatgtcattttcttccatttgtacaaagcaggcaatactgagcaactaccttataggaataactgagttaatatctaaggggctttcagcagtacctgaaatatagtaagtgttacatatatgtttactctttttattttatttggaattgtgaactgataataattgaagcctacctgctagtggccatctctgctgccaggtgaaaagagcctgacttagaatgaagtcagcgaaggaaagcagagtggagagaaaaagagagactgagtcctgatgacatcatttatttacctagacctagctgcttgtgaatagagccctactgtgctgaatagcttctgtctgctcttttctattctgctccctgctctgtgaggtaggttcctttgctctcttgcttttggttgggttcaacaaatgggaagcaccagtgggagattagaagttgagaggaaaatgaaatgatgttatttatttccctggctcctttcctgccatgtcatcatcagttggctgtgttcctctactaaatagtaccttatcaggaatcctatctcttctgttcccaagcagttaccccagttacctcactaggtttagttcctgctccctccctttaccccttttcacttagggttggtaatagcttacagttattactagccccagtatagttcactacaacttgttgctttacctaaaccctgctcatacatttgtaaatactgtagttgttttattacactcttctcaaatgtccccacttgaaatagccttctatttcttttggggactctgataaattcacctgtttgggtgaaataatagcacatttcctgaagtatatacagtgggacacatgatgttttatgggggaaagagttcttggtgaaattagtttgctgtacattacgttgtttccctcccagggattcagaaggcaaaacatattaaaggttctgaaaagtcctgaaataaacattttgaactttatttaagctgatatatcttaaacttacttgaatatgtagcacctattaacatgccatggaaataggacgtttggagtattgtaattaagaacaattcctattaatatacatggggcaactgagaattaaagaggtaagtaaattattgatagatcatacacctagttagtagcagagcctgttctagaatctggaacttctgatttggtttggttcagtaaggtcaccattatattatgctattcataaaaaggaatgtggattatataaggcttgaacattattagtcttacagtcttagccaaataaactaactggcttgcttattttagcagttattctacaagaatggaattaaaatagattttttttttcatgtttagaacttggccctgggaatagaggaaggcttgaattgatttaagcagggccaaagttggatttctctaggctaaatttggacttccctgagccaaaatctattgcatttaactggctttacaaaccaactaaacataacagttcagagggaaaagaaaaaaaaaagcgagagacagagaacaattctatcactcatttgcctccatctctcagctggcataagaaagatgacccacgtacttcataagagcctaatttacagctaaggccagataaaatctcaggttcttttcaaaagaagttagtaatacctattagaacaatgaattgactatacttgtcttagttttttttgtttgttttttgttttttgtttttttggtgtgatagatgtaacagtggccctaattctttatccttgcttgtattcatggtcatttttcaggttcctttgaagtactccccccactgtgattctgggtcatctgcattcagagatttagtgcatttttacttacacttgtgcttctgctgttgacataagaatatgcatggctgagttagcctgctggagcatgagactccatggaacagagccaggttgccctggtcaccctcactgaatcttgtctagattggctgatggccagccaaacccaagatatgtgaatgattccagccaagatcagcagagtcatctaactgacacctacctgattccaaacatgtgagcaaggaatgtctattatgccaccaatgtcttatagctatttattgtggctatagatatctcatctttggatgcattatcagatcatcttcttcaagtaccttagaagattctcagtctcatgtttcttgggctcttgaccacttgctttgccttagctaccacctcatatagtaacagattaccagcaggtttgtatgattcctctgcttgagatcaattagccatatgttcagaatccctggcctataacaacacttctgtgctttaaaaaccccatgccacaatgactgttaaaagggctaggcgatgtagtctggtaggtttgtgaagttaactgtctgaaaaacttggatcaatggactagaaaaagctgctgggtaaattgctcttcttctgatggactgtatagagacactgtttttcatcttgcctgtccagaagcgtactctgtggccaagcaagtgtacttgccacatgattggcagtgtctcttcatggcttttcatgaaacagcagcaagtgctacacagtaatttatcagtttgcatttgcctcccattattgccagcctcacttcctttcttcctcgctcttaccagcctggattgtacctttaataaagtagtggatatatttcctttagggtctctttttctagggaagtcaggtgttttagtctggatttagttagaaaagcagcatcgttacaagtattacatgaataaagaagtttagtaaagaaattaaggtttaccccaatgtgagaattactggggtaataaaggtctggaaggctgcagcagaagagatttagagaagcagtgactaactaggtcagccggagattctcaaagtactcatgacttcatttgtagaaacatgtatatcttaagcatatcaagtgtctcattcctctaatctttctaggagccctttggttcatcctgaaggtccccctaaatcccttcagaagtcttaaaaaggagtaaatggccacaccttttatttgttcttttctttgaggccatgttaatggcagtcccttgatttggtctttgtactaggctgtttttaatgatcacattttatttgatgagaaacaattttattttctagttctgcatatcctaggttatgtatttcatttcagttccatttccatacccattgccttaattttgagcttgtctgtttcttacatttctcattttgacagaataagctgactgttattaagtacaatagataaggtacctaagagcctcgaaacatcaccaaataccatgaatgcattaggtatattttttgtcttccatgttactggaagcattaattatagcaactttttatctccaaatactgacaattaaaagaccctagtgaaaactttaaccaaacacttactgaccctacattgaaggccaccagccaaaaatcaccacccatacataagagccaaacatcactagacacttggtgaaatccttcaaatataaaaggggaaaaggaggggagaaaatccaaaggaaatagacaaacggagaataatggcaacaaaaaaaaaactgtcttcaaaataagagtatattatattcacaaaacaagaataggagagtgtgaaaaagaacaagcaataaaaaagatctcagaaatttaaaaagtgattgctgaaataaaaattaaatataagagttgaagataaaatatagcataagaatagaaaattctgaattccaaatacctaaggccaatcttagttaaaagttgtaaatgcaaccataggctacatgttacattgtatttaattaaaaaccttaagaggaaaggcaatagagcttgtaacagctattacccttggttgtaaaggagaaggttggagattatttgtataccaactacttaagtttacaaaaaataatgagcattaggtagatggaatgaaagtctattcatacactgtatattaagctctatatacactgcatatcatcatcatgacattgagtttctagctggattgcagagatgagccaaagcgcttctccccaaattattatttattcatttttgagacagagtctcactcttgtctcccaggctgcagtgcagtggtgcgatctcagctcactacaacctccacctcccaagttcaagcaattatcatgccttagccccccgagtagctgggatcacaggcatgtgccaccacaccccgctaatttttgtatttttagtagagatggagttttgtcatgtttggccagccttatctgaaactcctgacctcaagtgatcctgcctttgcttcccaaagtgctgggattaacaggcctgagccacaacacccagcctaaattatttttaattatgacattttttgtattcccttgaggcactgacaactatagtcttattttatatgttatagtgaatcatatttatctcattatatattacagaatattttgtttgatggagaaaattcactgacctgtgctgtaatgtttataccagcaattagctgattgatttactatgacctcactctttattcagcagttctgccactattactagctaatccaacaacgaggccttattttggctttctttcgaaaggtcatttctgaccccagcttgaagtttgtttattttcacttgaagagatctctcagaaagtcaaagaaaataggaggaaaaaaacttaagattaagggccaatctaagaggtccttcatttgaataataggagtaacagaatgggaaaggcgtggaaaaaaatttgtgatttctaaaattgaggacattaagtcattagagtaaaaaaaagatgtacattaaggcttatcatcaaggaatttcagaacactgtggatagaaaatactaaaagatttcaaacagaagaaataggtcgtatatcgaccaataatcaggatattaaaggacttcttaacaacattggaaactagaagacatggggtgatgcctttagaactttaagtgaaaatagttttctatttggattctatttttagtcatgcaattaatcaagtatgaatatagtataaagacacagaaggtctcaaaggtattacctcccatatattcttgagataaagatgcttaggagaatactgaagatgttttccagtaaaacggagaaggaaaccaaaaaccaaaaaagagagcattaagaagtcagcaggccaggcgcggtggctcacgcctctaatcccagcactttaggaggccaaggcaggtggatcgcctgaggtctggagtttaagaccagcctggctaacatggcgaaactctgtctctactaaaaatacaaaaattagtcgggtgtgatggcatgtgtctgtaatcccagctactcgggaggctgaagcaggagaatcacttagaacctgggaggcagaagttgtagtgagccgagatggtgccattgcactccagcctgggtgacagagtgagactccgtctcaaaaaaaataaataaaaaaataaaaagtcagcaaagggaagtttcagggtttcaggattcattcatccattctaaaaaattttgagtgcatactatgtgtcaaattattgtctaggtgatggctatagcatgccgaggtagtaagtgctaagaagaaaataaagcagagtaaggaactgatagtgactggtgcaggaaaggggtgccagtttaaatagcatggtcagatggaaaagcctgtgataaggtaaaattgagcagagacctaaatgagagagagtgaaccatgcgaataattaagtgaataatgttttaattatagggaacaatatgtgtgtgtctatatatatatatacacacaaaggtactgaggcagcagtatacttggcatgtttgaggaataacaaggacactagtttggaacagtgtgtgggagggaaaaaatgatagaagatgacatcatagggagtaatggtgtggagccatggtaagatgttaagattttactctgagtgatgagataggaagccatcagagaatttaagcaaatgagtgacaggatctgacttatatttttaaaggattatttggcttctttatgaaaaatagactgcaagagagtaagaaataaaataggaagatcaattagaatgctatttcagtagtccatttgagagatgatatttgcctggacaagggttgtgatcatgggcgagtggtacagaatgacaagatcctgcatgtatttttaaggtagagccagtatttgcagatagtttagacattgtggtagatatgaaaatgtgctgcctatatcccccttctaggaaggacttgctaattagctgcagggagtgtgaagaacagaaatccaccagtatcagcacttcatctgcaacagctatagaaaaagcttcacctgaggttaccctcgtcttagatctcagggcagccctcagtggagatgtaaggccttgctacttcagcctcatttattacactgtcaggcaaaaccttcctcagagctccctctattacaacttaatttcttcttctgcccaatcctgcttcctccccttcccctgaaaggtgacactttctaataaacatcttacaccccaaactccatctcagcattcctctttagaggactcgacctgtggtaattgttagtaggagtgatctgagctgccaatgagaatcccatcacatgtggcacatggaacaaaagcccatggctcaaggtggtaacttttattagtggtaaaatgagaagatttacccacggaagagaatgtgccagcaagtgcagtatatcaggtatttgagactcatgaaggaaatagtaaatttaagaataacagaattgaatggccaagtgccactaatgctctgtagaaagagggcttctttggttgcatacaaatctcatctagaatttaatagtccaagtagccaaactggtatttgtccttaagaataaatactggaagatcaagcacagaaagtctagaatagaggcatgtgaatggacatacttgtgtcaagtatgtacatgaactgtgaaggtctctgtattacgtgcagtgcccaccagagagcattcagtactgaagagtctctaaacaataaagcaaactaaacacattgcctagttgacgtcatccttcctgcttcagttattcgccacccagtgctagcacagtgggcacatgaatggaatgtccactgtggaaaggatgaagactaagcatagggttcagtagcttgagtttcaacttaccaaggctgccttagctgctgctgctgttgaatgtccaacctacaagcaacacagacaatactgcacccctgatataataccattcttcaatatcaagttggttacattgggccccttccacactggaaggaccagcatttccttgtcatagaaatagacacaatttccagataggagtttgcttttcctctttgcagagcctcagtcagtatcaccatttgagtttacttagtattgtattgaccagcatgcgatctcacattatatcatatcagatccggaaacctattttatggaaaaccaagcgcaggagtggacccatatccacaggatccactaataatatcacttttttcaccacttggaatttgtcagcttgatagaacattggaacaacctgctgaaggtacagctgaacaccagctcataggcaaattctacaaggataggatgccatactccaagatacagagtatgtactggatcaattatccttatatagcatgtgccccaatatgaagaataaatgggtcttggaacccatttattcctaggggtagatgcaaagagagtagaagaagaggtgcctcccctccgtgccatcacttttaatgacccatatggtactttgcacctcttcataactctgaactctgcagtgagaggtcttggtcccacaaggggacacagttttgctgagagatatataaaaaatctcactgaaaaacataagctgcagcagctacctggatactttcggttccttgtgtctgtctagggagcagcagccaataaaaggagtcaagatcagttgaccctaatcaagaggagattggaatcctggttacacaatctgggcagaagtaataaatgtggtgcccaagtgataaacctaccaaattgagactaatgtgtaggtgtggcaacccatcctcaaaagggcatgatggcctggaactcaggcctctcaaggaatgtgggtctgaattataccagataaaccaccaggagcagcagaggtggtagcagaggctgagggaaatctagaattgatagtggaggatgaggggatgtgacaagtattgatggcattcccaagccccactgcagcagcaagcactgtaatttgtcccactaatctcccatcttctaaatttctgagaggtcaagaaaagaggtctcttgattcctttaggaactgctccctaagcatacagggagacatagatctatgtggagcaaagggtggattgtaataagcaaagagatacactgcctgattcactttaagaaaggactgacctcccagttgcaaggaatgaggtcagcagcctccaactgtcagctccttcagagtctgcttcaactgcagaaggacactgtgcttgaggtcatacccttcccatgtctggtgactgaagtccagctgaatgtagctgccaaagttaccttaatgcccatgggaagcaaaaaatcaaagagtttaaacagaattttgagaaatcccaaatcagttttttttcagcatatgacattttggagtagtttgttattcagcaatagataacagaaattggtatcaggagtggggtgttaccataacaaaaggttaaaccttacatggtaaaaaggactttgcctctgtcattaagttaagcactttgaaatgtagagattatcctgaattatctaggtaggctcaatataagcatgagtccttaaaagtggaagacggatacatgagaggatgtcagaatgatgtgaaatgagaagaactcaacctgctattgttggctttacaggtgagtgataggaaccacaagccccaagcagcctctggaagctggaaaaagcaaagaaacagattctttccagagtgtccagaaaggaatgcagttcagctaacatcttgattttagatcagtgagatttttgtgttggacttctacagaactatataagaataaattgtgttgcttaagcacactataatacatgtggcaagaagctgccagctaagccttgaagaatagtgaacaaactcttactggaggatgggaaggcagtaaataaattattgaattattgaaataaatggaggattgagttatgcattgacagaatgcttagcaataattttgcttgtcttaatgtggaacagaaaatgaaacttaatagcttgtagatgtcttaaggagatttccaggtgaatgttgaaagtactgatgaacttattatggctgcatctcataatgtacaggaagacatttactgagtgaactaaagaaggaactgttcaatttgaaagcagaatttagaggaaatttttcaacctagtacttgtcatttttttatagaaaaggaaaaatagatggaagatggagccaaaatcccagagggaggagccaagaagcaaggagagcaatggattaggaaaccactaccagagggatgaactgaaccacaatcaaggaatagcctcttcctttggtgtagggggaccctgaaaacaatttaattttatgcttcctgtttccttgtctccttttttgaatgatagtctctgtgtggtgttcctatcctagaaaaccttaactgggacaagctactctcaagcatcttcacttgagaaacagtaactgaggaagtttattgtatctggacatggtttagatgataagattctgaacttaaacttatgccataatggagtgagactcttagggtacagagtaagtacatttttgcatgttagtgagacaagaactgtggccgggggcagactgtgatagtttttgaagatgtccctcaaacaattccttcccttccttggactcctctcttcagagggtagagtccatttccttttccttttaatctggattggccttctaactcactttgaccaataaaatgtggtaaaagtaaggtctggcagttttcactttcactctcctgaaccttcatattagaattccaggatatccttctagagatatccatatctctagggacatggtgagtccctagagacaccacatggaaaggccacctagggaagaactgagatgccccagtcaatagcactgccttagtcagtttgggctagtataacagaaatatcatagattgagtgactttttttctttaaaaaaatgagattgtggaacctgaaaatacagtgtagtaagagtggagagaaaggccacctaaggaagaactgagacgtcccagtcaatagcactgccttagtcagttggagctactgtaacaaaaaatatcatagattgagtgacttaaacaacagaaatttatatcttacatttctggagactgaaaatatggaaatccaagatcagagtttcagcatggttaggtgtttagtgggcgctcccttcctggtttgcagacagccatcttcctgctatatcctcacatgatgcagagagagagaactctggtatctttgtccccttataagggcaccaatctcatcatggagggtcttcaacctcatggcttcttggaaccaaattacttcccaaagtcctcacctccaaatctagcacattgaggtttagggcttcaacatatgaatttcagtgcatagaaagcaccaagtcctcagacaaagagaacttgaaccttctaactcagcttagccattatctgcatgcaaccacataagtgaccctgggtaacaccatctggagctgaagaaccaccagccagtacacagaaatgagaaattttaaaatggttgatttaggtaattaagttttggggtggtttattacatagcaattgataactgatacaacagtcttttcgttagtagaagagggggtaagaaagaaagacttatgaagaaaagacctgtagaaaatcgggcctacgtacctctatttttttttcatactcccgtgttttttttagtccatgctggtggtatcctcatcaatgcaattttctttaaaactctgtgagcctttatatcagattagtccaccccattagaacaaaagcaacttctataaatattgagacattccctttctacctttggctaagaattggggtgctatagataattcccaaaagattatctagcctacagggccgatgaggtatagcttgaagtcattctaaagtcttcacaaaggatcttacagcctttgattttattatcactctgggaccacgttttactgttggcacgttcggcttttctcatcttttccctgagatcatttatgatgtggaaattactttgctggctgaagttgggaatagaaaacagtagagaatacttcaagagtattctaggtatgcactaagtttatgggaagatatgccatctacataatttaccttcctctctaggcccatcataaaaatctttgaaaaattaatactacattttagtatgaatataagttaaacttagaggtgatatctattttgtggttaaatgtgttataaacatttatttagtgaaatacagtacaattacaacaagcatcaatgaatatttaatgagcagctgttaatttctgaagcagaaagaaagatgaataaaagttctggttttacttttaaaagtgaaggctaactgttagctcaagaaatactttatgtttgtcctatatgaaagtgttgattgcacctggttctttgctgtaaattaaataaaaattcaaatatttgtaaaa

SEQ ID NO: 128129 - DNA, 1584 bp, Homo sapiens
  Payload ID: 5087
  Gene Symbol: DTWD1
  Gene Name: DTW domain containing 1
  Uniprot ID: Q8N5C7
  ENST ID: ENST00000403028
  CDS Start-End: 199-1113
gctagtaactgcctggctcctccctctggtgtctcccggaaagcgctccgtctggtccgtgcgcgatcacggcccggcgcgtggctcgggctcgggcggagctggagacgtgtggagctgttcgaggactcgcgggtgtgcagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgatttgaatgacagcaagtgcaaaggcacaacactgaaaaaaattatatttatagatagcacctggaaccaaacaaacaaaatattcactgatgagcgacttcaagggttgttacaagttgagttgaaaacaagaaaaacttgcttttggcgccatcaaaaaggaaagccagatactttcctttctacaattgaagccatttactactttctggtagactaccatactgatatattaaaagagaaatacagagggcaatatgacaatcttttatttttctattcttttatgtaccagttgataaagaatgccaaatgctctggagataaggaaacaggaaaacttacacattagtttttaacaagccacttatgtctttttattttgctaacattaataaacttatatttgtgctttgttttttcttaagaaataatcatatataatgcctgtaagaccatttgaaaaaattccagtttcatatatatcacttcatatttcttgaaggaaattgtatctgggggaatttttcagagatactgttgattgaaaaacttacttcagaagttatttgctcagtgaaacctcagtttcattactacattttaatatagtgtgttatgtctctgtgattagatataacatattccattagatctaattagctatttatttcaacatctttatatcttttcacctgtactcatgaccacctttagaagtaaatggggttacaatctgctggctgaaaaataggtcataagtgatttttcttgaggttagtagcaaacataggcagaactagaattagaattctggtatcta

SEQ ID NO: 128130 - DNA, 936 bp, Homo sapiens
  Payload ID: 5087
  Gene Symbol: DTWD1
  Gene Name: DTW domain containing 1
  Uniprot ID: Q8N5C7
  ENST ID: ENST00000557968
  CDS Start-End: 142-471
cgtgcgcgatcacggcccggcgcgtggctcgggctcgggcggagctggagacgtgtggagctgttcgaggactcgcgggtgtgcagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagtttagcctatatcatcttggccagtccatggtctcctcagcatctaaaatcacatgtataggctaatggaaagtttactagccaagaataagtaagtgtggaatttaatatgatcttcacagtttgctccgaaaaaacaagaacttgaggataatactgatgtggtgctcagagaccctagggagagggaaggtagtttcaactgagaccgagcgtcatgaggaaactctgatgtagtgttcagccagaagtagactgatgtaaaatcatttgtgaactgcctacttaaatggtaaattttccataactagaagttggtttgatgattagaagcaattgggcctaacttataaatgatcattgggcctaacttataaatgattgctaggcctaagcggggagggtaggagatacagcatttgaaaccctaattgaaaactatttgaggaattcatttgtaggccaaggtcctccaggggtgtattatttatactgttctgtccccaacataattgtccaggaagaaaaaaa

SEQ ID NO: 128131 - DNA, 583 bp, Homo sapiens
  Payload ID: 5087
  Gene Symbol: DTWD1
  Gene Name: DTW domain containing 1
  ENST ID: ENST00000559405
  CDS Start-End: 301-583
agacgtgtggagctgttcgaggactcgcgggtgtgcaggtctgagtaccactccgatccctggtggaggtccccgcgcctctctggagaccagtggtctggccccagaggtgcggccgcgggaagtggacattctttgtcaggaccctagcggaggtcgcgctgggtgtcgcctgtgagggggatcctcggtttctgcgcggtctcttgctttttttaggatcttgcgggccctttgggaaaaagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgaca

SEQ ID NO: 128132 - DNA, 678 bp, Homo sapiens
  Payload ID: 5087
  Gene Symbol: DTWD1
  Gene Name: DTW domain containing 1
  ENST ID: ENST00000559164
  CDS Start-End: 99-678
gctggagacgtgtggagctgttcgaggactcgcgggtgtgcagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaaagacaggtctcactatgttgcccagactggtctcgaactcctagggctcaagtgatcctctcaccttggcctcccaaagtgccgggattacaggttgcactcatttttcctggacctcagtctatctcaataaaagatatttcttttcatctgcaaaaaaggattcaaaata

SEQ ID NO: 128133 - DNA, 1131 bp, Homo sapiens
  Payload ID: 5087
  Gene Symbol: DTWD1
  Gene Name: DTW domain containing 1
  Uniprot ID: Q8N5C7
  ENST ID: ENST00000558653
  CDS Start-End: 185-1099
tcgggctcgggcggagctggagacgtgtggagctgttcgaggactcgcgggtgtgcaggtctgagtaccactccgatccctggtggaggtccccgcgcctctctggagaccagtggtctggccccagagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgatttgaatgacagcaagtgcaaaggcacaacactgaaaaaaattatatttatagatagcacctggaaccaaacaaacaaaatattcactgatgagcgacttcaagggttgttacaagttgagttgaaaacaagaaaaacttgcttttggcgccatcaaaaaggaaagccagatactttcctttctacaattgaagccatttactactttctggtagactaccatactgatatattaaaagagaaatacagagggcaatatgacaatcttttatttttctattcttttatgtaccagttgataaagaatgccaaatgctctggagataaggaaacaggaaaacttacacattagtttttaacaagccacttatgtctttttatttt

SEQ ID NO: 128134 - DNA, 552 bp, Homo sapiens
  Payload ID: 5087
  Gene Symbol: DTWD1
  Gene Name: DTW domain containing 1
  ENST ID: ENST00000560632
  CDS Start-End: 97-552
tggagacgtgtggagctgttcgaggactcgcgggtgtgcagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctg

SEQ ID NO: 128135 - DNA, 1201 bp, Homo sapiens
  Payload ID: 5087
  Gene Symbol: DTWD1
  Gene Name: DTW domain containing 1
  ENST ID: ENST00000557988
  CDS Start-End: 105-413
ggcggagctggagacgtgtggagctgttcgaggactcgcgggtgtgcagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaaggagaatccaatgcctgaagatctgtcactgtctcccatgtcctagatgggaccatcaagttgcaggaaaaccagctcagggatcctgctgattttacattatgcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgatttgaatgacagcaagtgcaaaggcacaacactgaaaaaaattatatttatagatagcacctggaaccaaacaaacaaaatattcactgatgagcgacttcaagggttgttacaagttgagttgaaaacaagaaaaacttgcttttggcgccatcaaaaaggaaagccagatactttcctttctacaattgaagccatttactactttctggtagactaccatactgatatattaaaagagaaatacagagggcaatatgacaatcttttatttttctattcttttatgtaccagttgataaagaatgccaaatgctctggagataaggaaacaggaaaacttacacattagtttttaacaagccacttatgtctttttattttgctaacattaataaacttatatttgtgctttgttttttcttaagaaa

SEQ ID NO: 128136 - DNA, 4365 bp, Homo sapiens
  Payload ID: 5088
  Gene Symbol: DTWD2
  Gene Name: DTW domain containing 2
  ENST ID: ENST00000304058
  CDS Start-End: 72-770
ggagtcggcggctcgggcagctctgcgattagggcggcggagttggcgggtgcacgttggaaatctcggaaatgccaggcacagctacctaccggcctcagaaagtgtgtttgtgtccatttctcccagcgcaccctctgcatatctctacccacttgtacataattcagcatccagcagaggaaaacaaagtgttgcgtacagttcctctactagcagcatgcctcccccaggacaagtgtaaagtgaagatcggtcgtcgcttcagtgaagaaagagatcctgaactttcaactgtttgccggaagtctggtacattaatattatatccaggggctgaagctgctaatttggaagaatttatattagattctcctgtttatccttctacaatcatcatcattgatggtacatggagccaggctaaggacattttctataagaactccttgttccgacatcccaaacaggtgcaattaaaaactagcatttctagtcagtatgtaattcggatgcagccgactaatagatgcctttctacactggagtgtgcagctgttgctctttccatcttggagaaaaataattacatacaagagactttgcttcgccctcttcaagctttatgctcctttcaacttcagcatggtgcccaaattcgcctcagcaaggaacaccttctgaaaaatggattatatcctaaaccaatgccaaagaacaaacgcaaactcaggaaaatggaattgttaatgaatagtgttaaaatttagtacagttattcttttggtgctagcttaactgtcttcatctaacaataccaaattaagttttcatatagttaaggtctgtaggtttttgacttgctaaagaaggagaattgcatactaatcttacccagaagaaggaagtaaaccaaatattcataaatacaaataaacagaaattcactggctcactgaaaagcaggatttcctactgtacttgtttttaaaaatgtgcctctaatacatgttttcaaacccaaatttaaaatatgatttgttgttgtgataggttagaagttcttacttgtaaaatagaagaaaattgttgtagtggattggaacggtgttgtgtccattaatgtttataaataattaggtgtagaccaataatataagattcctacatcagtttgcagtcctgactttacagtttgaaataagtagcaaaagaaaattatgataatcaagtaatttattattttgtaaaatagtataaaggaataaggaaattttaagtattgtttaggggccaaatttgaactcagctaatatgatttaagcgctctattaattgccctgatttttaaagaggtgcatgtaattttgaaatagcacacattttcatttgtaatcactctggataaatttgtatttttcagtgttcattgaacaggcttattgactctggtaaacttattttattgatgttttcatatggaaaataataagtggaatatgatacaattgttattttcagaacatatttctttagggctatttaatataacctttttaacgagcaaaaactttccatttgagagaaaaaattcttcctgctctgtgggaaaatatttgctgagattttgtatagaataagagacatgtatgtaacatatatgtatattcagcacaagtctactgcaattatgtacacattttggcaggaagaggggattttgtttagtctttgtttatgagttctagagtttcctgtatctagtgttaagttgtaaggaaaaactaaacatgccatttaaaggtaaacttggtaactatttatagagcatacaccaatgattatttctcacagttttcatgatcatttgtttattatttacttggattagactcattaaaaggtataatgctggtcacaattagaatgctaatatttggggaaactatgcagaaaatattttaaaatattaaaagagtgctggcttctattgttgatttatttttggatttaaaaacaaattagggctgggcccattagctcacacctgtaatcccagcactttgggaggctgagatgtgagaattgcttgagcccaggagtttgagaccagcctgggcaatatggtgagactccatctccatacaaaattaaaaaaaaaataattagccagatgtggtggtgtgcacttgtagtcctagctacttgggaggctaaggtgggaggatcgctggagcccaggacatcaaggttgcaaggagctatgttcattccactgcactccagcctgggctacagagtgagacctgtctaaaataaataaataaataaacaaactagctcatttacaatgtaaagcacttaatatcaaatgattatttggtgtactagaaaagaaacagcatataataatgtataatagtttcttaacaagtggggctaaaatcattttgtagtaatttttcacattgatattaaacttcatgagtttcttttagtcattattattattattattattatttgagatggaatctcgctctgtcgcccaggctggagtgcagtggcgcaatcttggctcactgaaagctctgcctcctgggttcacgccattcttctgcctcagcctcctgagtagctgggactacaggtgcccaccaccacgcccggctaattttttgtatttttagtagagatggggtttcaccgtattagccaggatggtctcgatctcctgacctcgtgatctgtctgccttggcctccaaaagtgctgggaccgtgcccagccatcattattattttttaaaaagaaaactccccctacccccagtataccattttgtatctcaaaattttactttattgatttttaagagtaatttctacttttatcttttaaataaaacattttagagtatttttgaagacttaaaaagcttaaaatttagtgtttttggaaatgtataaaattttcttgaagtatgtatagttttccaaattactttactgacctgttaactcactgtacttgttttttacttattttttcctgacctcttaacaaggtgagtccatttaatcatctgtggtataaaatgcttctctagtcacctgttctcattaaacagttgtaagtaagttttaaaagccattattttaattactaaaagttctcaagtgtgtagtattatctgagtattttaattgaaaaattaatcaggcttttaaaaattacttttttattgtattagttggcttttaaattcagattctttatatttgcttgatttttcctggaagttccaagttttatgaatttgtagctgatagtaggttttacttgtgtaccccatctgcactttgatgttgtgtagatcgttttgtgagttatttgaaccgtgtaactcagagaatagtatttcctcatacataaagtgacctcacttttaatcagctcctttatagtatgttgaaaatcactgcgtgtaatgagaggtattgagagtttcttgcacacatgagtgtaaaaggttgagaactagattatacaaagtagtaagtcacagtgcatggcaactttctacaggttggattataagacttatgtggaataggagaattatattgggaaaaaattattttctctaacttgaagactccagagacacttttcttagtcatgaccagtaatatttttcatatattttggaagaaataagctcctcactataccaccagttagtgatttatttatttatgtattttagagacagggcctccttctgtcacccagtttggagtgcagtggtgtaatcatagcttactgcagcatcaaactcctgggctcaagtgttcctcctgcctcagcctcccaagtagctagaacctcagccccatgccaccacactcagctaattttaaattttactaatttcatttaatttttgtggagatgggggtcttgctgtgttgtttaggctggtcctgaactcctggcctcaagcgatccttctgccttggcctctcagtaaattatatagaagagcacttctgtataatttactcagtttcttcatcacatatttccaactgttgccctaaataggtttaaaaatgtgatcatgttattagaaaatcctttccattgaatttcagggatgctgaatttcagggagctaaattgttgacccttgcctgtagttgttattggttcagaagtaaattttattgatgctacaagtaaaaaattagatctgacttagtaaactcaaaagttttacaaaactgtattttactatgtagatgtatttctttaaaataggtatggatggatatttttatgaataaataatattgcattata

SEQ ID NO: 128137 - DNA, 1275 bp, Homo sapiens
  Payload ID: 5088
  Gene Symbol: DTWD2
  Gene Name: DTW domain containing 2
  ENST ID: ENST00000515439
  CDS Start-End: 29-637
atgccacggcctgaccggagtgtccgccatggagtcgcagaaagaggcacgaacactccaggagcccgttgcgcggccttctggggcctcaagctctcagacgccgaacgacaaggagcggcgggagggcggcgcagtgccggcggcggctgccctgggcgcagaggcggacgacgacagtgcggacgggctgtgggagctgccggtggagccggccgagcggaggcctgagtgcacccgctgcagccggcctcagaaagtgtgtttgtgtccatttctcccagcgcaccctctgcatatctctacccacttgtacataattcagcatccagcagaggtgcaattaaaaactagcatttctagtcagtatgtaattcggatgcagccgactaatagatgcctttctacactggagtgtgcagctgttgctctttccatcttggagaaaaataattacatacaagagactttgcttcgccctcttcaagctttatgctcctttcaacttcagcatggtgcccaaattcgcctcagcaaggaacaccttctgaaaaatggattatatcctaaaccaatgccaaagaacaaacgcaaactcaggaaaatggaattgttaatgaatagtgttaaaatttagtacagttattcttttggtgctagcttaactgtcttcatctaacaataccaaattaagttttcatatagttaaggtctgtaggtttttgacttgctaaagaaggagaattgcatactaatcttacccagaagaaggaagtaaaccaaatattcataaatacaaataaacagaaattcactggctcactgaaaagcaggatttcctactgtacttgtttttaaaaatgtgcctctaatacatgttttcaaacccaaatttaaaatatgatttgttgttgtgataggttagaagttcttacttgtaaaatagaagaaaattgttgtagtggattggaacggtgttgtgtccattaatgtttataaataattaggtgtagaccaataatataagattcctacatcagtttgcagtcctgactttacagtttgaaataagtagcaaaagaaaattatgataatcaagtaatttattattttgtaaaatagtataaaggaataaggaaattttaagtattgtttaggggccaaatttgaactcagctaatatgatttaagcgctctattaattgccctgatttttaaagaggtgcatgtaattttgaaatagcacacattttcatttgtaatcactctggataa

SEQ ID NO: 128138 - DNA, 1370 bp, Homo sapiens
  Payload ID: 5088
  Gene Symbol: DTWD2
  Gene Name: DTW domain containing 2
  ENST ID: ENST00000506980
  CDS Start-End: 29-442
atgccacggcctgaccggagtgtccgccatggagtcgcagaaagaggcacgaacactccaggagcccgttgcgcggccttctggggcctcaagctctcagacgccgaacgacaaggagcggcgggagggcggcgcagtgccggcggcggctgccctgggcgcagaggcggacgacgacagtgcggacgggctgtgggagctgccggtggagccggccgagcggaggcctgagtgcacccgctgcagccggcctcagaaagtgtgtttgtgtccatttctcccagcgcaccctctgcatatctctacccacttgtacataattcagcatccagcagaggaaaacaaagtgttgcgtacagttcctctactagcagcatgcctcccccaggacaagtgtaaagtgaagatcggtcgtcgcttcagtgaagaaaggtgcaattaaaaactagcatttctagtcagtatgtaattcggatgcagccgactaatagatgcctttctacactggagtgtgcagctgttgctctttccatcttggagaaaaataattacatacaagagactttgcttcgccctcttcaagctttatgctcctttcaacttcagcatggtgcccaaattcgcctcagcaaggaacaccttctgaaaaatggattatatcctaaaccaatgccaaagaacaaacgcaaactcaggaaaatggaattgttaatgaatagtgttaaaatttagtacagttattcttttggtgctagcttaactgtcttcatctaacaataccaaattaagttttcatatagttaaggtctgtaggtttttgacttgctaaagaaggagaattgcatactaatcttacccagaagaaggaagtaaaccaaatattcataaatacaaataaacagaaattcactggctcactgaaaagcaggatttcctactgtacttgtttttaaaaatgtgcctctaatacatgttttcaaacccaaatttaaaatatgatttgttgttgtgataggttagaagttcttacttgtaaaatagaagaaaattgttgtagtggattggaacggtgttgtgtccattaatgtttataaataattaggtgtagaccaataatataagattcctacatcagtttgcagtcctgactttacagtttgaaataagtagcaaaagaaaattatgataatcaagtaatttattattttgtaaaatagtataaaggaataaggaaattttaagtattgtttaggggccaaatttgaactcagctaatatgatttaagcgctctattaattgccctgatttttaaagaggtgcatgtaattttgaaatagcacacattttcatttgtaatcactctggataa

SEQ ID NO: 128139 - DNA, 2307 bp, Homo sapiens
  Payload ID: 5088
  Gene Symbol: DTWD2
  Gene Name: DTW domain containing 2
  Uniprot ID: Q8NBA8
  ENST ID: ENST00000510708
  CDS Start-End: 35-931
gcttcaatgccacggcctgaccggagtgtccgccatggagtcgcagaaagaggcacgaacactccaggagcccgttgcgcggccttctggggcctcaagctctcagacgccgaacgacaaggagcggcgggagggcggcgcagtgccggcggcggctgccctgggcgcagaggcggacgacgacagtgcggacgggctgtgggagctgccggtggagccggccgagcggaggcctgagtgcacccgctgcagccggcctcagaaagtgtgtttgtgtccatttctcccagcgcaccctctgcatatctctacccacttgtacataattcagcatccagcagaggaaaacaaagtgttgcgtacagttcctctactagcagcatgcctcccccaggacaagtgtaaagtgaagatcggtcgtcgcttcagtgaagaaagagatcctgaactttcaactgtttgccggaagtctggtacattaatattatatccaggggctgaagctgctaatttggaagaatttatattagattctcctgtttatccttctacaatcatcatcattgatggtacatggagccaggctaaggacattttctataagaactccttgttccgacatcccaaacaggtgcaattaaaaactagcatttctagtcagtatgtaattcggatgcagccgactaatagatgcctttctacactggagtgtgcagctgttgctctttccatcttggagaaaaataattacatacaagagactttgcttcgccctcttcaagctttatgctcctttcaacttcagcatggtgcccaaattcgcctcagcaaggaacaccttctgaaaaatggattatatcctaaaccaatgccaaagaacaaacgcaaactcaggaaaatggaattgttaatgaatagtgttaaaatttagtacagttattcttttggtgctagcttaactgtcttcatctaacaataccaaattaagttttcatatagttaaggtctgtaggtttttgacttgctaaagaaggagaattgcatactaatcttacccagaagaaggaagtaaaccaaatattcataaatacaaataaacagaaattcactggctcactgaaaagcaggatttcctactgtacttgtttttaaaaatgtgcctctaatacatgttttcaaacccaaatttaaaatatgatttgttgttgtgataggttagaagttcttacttgtaaaatagaagaaaattgttgtagtggattggaacggtgttgtgtccattaatgtttataaataattaggtgtagaccaataatataagattcctacatcagtttgcagtcctgactttacagtttgaaataagtagcaaaagaaaattatgataatcaagtaatttattattttgtaaaatagtataaaggaataaggaaattttaagtattgtttaggggccaaatttgaactcagctaatatgatttaagcgctctattaattgccctgatttttaaagaggtgcatgtaattttgaaatagcacacattttcatttgtaatcactctggataaatttgtatttttcagtgttcattgaacaggcttattgactctggtaaacttattttattgatgttttcatatggaaaataataagtggaatatgatacaattgttattttcagaacatatttctttagggctatttaatataacctttttaacgagcaaaaactttccatttgagagaaaaaattcttcctgctctgtgggaaaatatttgctgagattttgtatagaataagagacatgtatgtaacatatatgtatattcagcacaagtctactgcaattatgtacacattttggcaggaagaggggattttgtttagtctttgtttatgagttctagagtttcctgtatctagtgttaagttgtaaggaaaaactaaacatgccatttaaaggtaaacttggtaactatttatagagcatacaccaatgattatttctcacagttttcatgatcatttgtttattatttacttggattagactcattaaaaggtataatgctggtcacaattagaatgctaatatttggggaaactatgcagaaaatattttaaaatattaaaagagtgctggcttctattgttgatttatttttggatttaaaaacaaattagggctgggcccattagctcacacctgtaatcccagcactttgggaggctgagatgtgagaattgcttgagcccaggagtttgagaccagcctgggcaatatggtgagactccatctccatac

SEQ ID NO: 128140 - DNA, 1387 bp, Homo sapiens
  Payload ID: 5089
  Gene Symbol: DTD1
  Gene Name: D-tyrosyl-tRNA deacylase 1
  Uniprot ID: Q8TEA8
  ENST ID: ENST00000377452
  CDS Start-End: 181-810
ctatcgccaggccgagagtgggcgtggccgacgtggggtgggtagcagccgaccgagtcggaccggccagttgggcgcgcttccgggtgtcacctccagagggcgccggctgcggagccgccctcagagtcgcgaggccggacgcagcgcggcgccgccccactcgccccagccgccgccatgaaggccgtggtgcagcgcgtcacccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtttggggcctacatgcaggtgcacattcagaatgatgggcctgtgaccatagagctggaatcgccagctcccggcactgctacctctgacccaaagcagctgtcaaagctcgaaaaacagcagcagaggaaagaaaagaccagagctaagggaccttctgaatcaagcaaggaaagaaacactccccgaaaagaagaccgcagtgccagcagcggggctgagggcgacgtgtcctctgaacgggagccgtagctcaggaggcagaattcagtgtgttatcattgggcagaactggatcctgaaaaattcaagatgctaagcacctacactactttaagaatttggaactgaaacatgaagaggaagacagaaataagaatttgggaacctgaatagctctgcaaaaaacaccaaaggaccgttttatcgttttctgttgttgctgtggtggagtgatgcagtgggcactgccggtgggccagggggcgggtgcgcatgtggtagaaggtgtgcgctcgtgcctcccccacagaaaggctttgttggtttctaccacatcttggcttgcttttggaacaggctggcccagcatcatttgtcatcaagtccactgtggtgtattctgcgtgtccatggcgggggttctccaatacactcacactgtccatgttctttttattgccagggcccgtgttgaagtgtcaagagagcaatcatcaatgataatgtattgtgtgagacctttgcatcttgtaaattttctcttttttctaaaaataaataataataaaatcctaaatctcaacaaaccactttattatcaaacaaa

SEQ ID NO: 128141 - DNA, 695 bp, Homo sapiens
  Payload ID: 5089
  Gene Symbol: DTD1
  Gene Name: D-tyrosyl-tRNA deacylase 1
  ENST ID: ENST00000618693
  CDS Start-End: 27-695
gaatcgaggcactcgctggcgtacccatgtatcgaaatgagttcacggcctggtaccggcggatgtcggtggtctacgggatcggcacctggtctgtgttgggctcactgctttactatagccggacaatggcgaagtcgtcagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtttggggcctacatgcaggtgcacattcagaatgatgggcctgtgaccatagagctggaatcgccagctcccggcactgctacctctgacccaaagcagctgtcaaagctcgaaaaacagcagcagaggaaagaaaagaccagagctaagggaccttctgaatcaagcaaggaaagaaacactccccgaaaagaagaccgcagtgccagcagcggg

SEQ ID NO: 128142 - DNA, 2717 bp, Homo sapiens
  Payload ID: 5090
  Gene Symbol: DTD2
  Gene Name: D-tyrosyl-tRNA deacylase 2 (putative)
  Uniprot ID: Q96FN9
  ENST ID: ENST00000310850
  CDS Start-End: 118-624
gggcaatcggcgcaggcccttcgtcgtgccccgcctcgtctgccccgccagcgcgtcgagggaggggccagcgacacatggcctagtaactgtccggccgcggcgctggcttaagccatggctgagggtagccggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggttaatacactgttaaatgtgaaattaagtgagacagaaaatggcaagcatgtctctatattggatctacctggcaacattcttattatccctcaagctacccttggaggaagactaaaaggaagaaacatgcaatatcactctaactctggaaaagaagaagggtttgaactttactctcaatttgtgactctatgtgaaaaagaagtagctgctaatagcaagtgtgctgaagctagggttgtagtggaacatggcacttatgggaacaggcaggtgttaaagctggacaccaacggaccattcacacacttaattgagttttgaaaatgaaaaactagtttctatagctgttttctggtatgaaatgatctaaagtataattagattttcttccccttaatcttgaatatactaatcttcagcatttttagacaggaaaatcttgggtttcatatataactctgcacctgctaattggatgactttgccaagtcacctaaactctggatctcagtcaccttttgtcctacattcctctacccttctacttgaaaatttgaaatatgctgtctattcacttcatagtcattaaggaaatgttcttaattgtttttttgtttttgttttttttttgagatggagtcttgctctgtcgccagactggagtgcagtggcgcaatctcggctcactgcaacctccacctcctggattcaagcgattctcctgcctcagcctcccaagtagctgggattacaggcgcatgccaccatgcccagctaatttttttgtatttttagtagagatggggtttcaccgtgctggccaggatggtctcgatctcctgacctcgtgatccgcccacctcggcctcccaaagtgctgggactacaggcatgagccaccgtgcccggcctcttagttgttttttaaaaattatgtacattttaagtattttgcaatgaagaaattcatgcaaacaagaaaaacacatttcttataccatcaaatttgtgtagcatgtaataaaaataactatttgtattaaaattaggtaaacttcagcacaacccaattataactttgttaattttgtttactatttcagttttctgtatttccatatgtaagtcaccatttcttttaataatatgcatgaaaatgtaatatagggccaaatgtggtggctcatgcctataatcccagcactttgggaggccgaggtgggaggatcacttgagcccaggagtttgcgaccagcctgggcagaatagcaagacccagtctctaacatatacatatacatatagatatatatgtaatatagaagggttattgtgtgttatattactttccagggacattcaaatgttttacattactttaagaatctttacttgatataagaacaaagtataagggtttaaaagttgtttttattaaacatactatataaatgggttaatggtctatttttcagtttttaccaaaatcatgtgtctcactttttgtcttcgctttttaaagaactggttcatgaaattagtgttagttcataaattgtttaagaagttccttttccattgaattagattgctgtaaaagggagaaaaagggaagcttcccataagaatagtttgaaaacaaattgacttgttcatttccatattatctgcttgatgatatggagccagtgtcaatttttctgttagtgaatgttttggactagatgttcccgtccccaaaatttatatgttgaagcccttattaatgtgatggtatctggagatggggctcctccaaccatcccatcctggaacatataagccagaaagaaagtagtctccagaaacagaccatgctgacaccttgagtttgaacttctaatcaccagaactgtgaggaaataaatttctggtgtttaaaccacccagtcctatggtattttgttagggcagtctgagctacgacagtgatataagatagacagctagtaaggtaaacttttcaaaggcaagagaggaagatatacaagaaattgaaagaataattaagtcagtaagaggtaatattcagttttggcaaactcctctgacttgagttgaaaatactttttttttttaagagtaaaaaccaaataactaattctaattggcaaaaaaaggtaaataaataaacatcctaagtagctgctgaaatttccgttgtgtcttatagtttctttaggtctgtgttcctaagatgcttaaaatttttatcatgaaaaatcctattttctctatacccttcctgtactgttctattttggaaccagagaatcaataactggcttggtaatgagctcattgtccttaacttttgctttattgattcacaatacacttactgaaatgtaataaactattcataaacttgcaaa

SEQ ID NO: 128143 - DNA, 1400 bp, Homo sapiens
  Payload ID: 5090
  Gene Symbol: DTD2
  Gene Name: D-tyrosyl-tRNA deacylase 2 (putative)
  Uniprot ID: Q96FN9
  ENST ID: ENST00000356180
  CDS Start-End: 33-539
gtaactgtccggccgcggcgctggcttaagccatggctgagggtagccggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggttaatacactgttaaatgtgaaattaagtgagacagaaaatggcaagcatgtctctatattggatctacctggcaacattcttattatccctcaagctacccttggaggaagactaaaaggaagaaacatgcaatatcactctaactctggaaaagaagaagggtttgaactttactctcaatttgtgactctatgtgaaaaagaagtagctgctaatagcaagtgtgctgaagctagggttgtagtggaacatggcacttatgggaacaggcaggtgttaaagctggacaccaacggaccattcacacacttaattgagttttgaaaatgaaaaactagtttctatagctgttttctggtatgaaatgatctaaagtataattagattttcttccccttaatcttgaatatactaatcttcagcatttttagacaggaaaatcttgggtttcatatataactctgcacctgctaattggatgactttgccaagtcacctaaactctggatctcagtcaccttttgtcctacattcctctacccttctacttgaaaatttgaaatatgctgtctattcacttcatagtcattaaggaaatgttcttaattgtttttttgtttttgttttttttttgagatggagtcttgctctgtcgccagactggagtgcagtggcgcaatctcggctcactgcaacctccacctcctggattcaagcgattctcctgcctcagcctcccaagtagctgggactacaggcatgagccaccgtgcccggcctcttagttgttttttaaaaattatgtacattttaagtattttgcaatgaagaaattcatgcaaacaagaaaaacacatttcttataccatcaaatttgtgtagcatgtaataaaaataactatttgtattaaaattaggtaaacttcagcactttgggaggccgaggtgggaggatcacttgagcccaggagtttgcgaccagcctgggcagaatagcaagacccagtctctaacatatacatatacatatagatatatatgtaatatagaagggttattgtgtgttatattactttccagggacattcaaatgttttacattactttaagaatctttacttgatataagaacaaagtataagggtttaaaagttgtttttattaaacatactatataaatgggtt

SEQ ID NO: 128144 - DNA, 823 bp, Homo sapiens
  Payload ID: 5090
  Gene Symbol: DTD2
  Gene Name: D-tyrosyl-tRNA deacylase 2 (putative)
  ENST ID: ENST00000549850
  CDS Start-End: 96-302
gtcgtgccccgcctcgtctgccccgccagcgcgtcgagggaggggccagcgacacatggcctagtaactgtccggccgcggcgctggcttaagccatggctgagggtagccggattcctcaggcccgggcgctcctacagcagtgcctgcacgcccggctgcaaattcgcccagccgatggggacgtcgcggcccagtgggtggaggtaacgtcagcccggcagctctcgttatcctccggcgtgcggggcggttttttccgcgttgtctcggtgactcgtccgctctgtgtctccctctgagaccggcggtccggccgcggggataccgggtcagcttgaagctggccgcggtggcctgcctggctgcgcttgtcttttcggtccagcatcaccgttccccagcgccagttgtagcacccgagaggaagagcgtgtctcccttcttggggggaccacaggtccaaagaggactggtgatctacgtgtgctttttcaagggagctgataaagaacttcttcccaaaatggttaatacactgttaaatgtgaaattaagtgagacagaaaatggcaagcatgtctctatattggatctacctggcaacattcttattatccctcaagctacccttggaggaagactaaaaggaagaaacatgcaatatcactctaactctggaaaagaagaagggtttgaactttactctcaatttgtgactctatgtgaaaaagaagtagctgctaatagcaagtgtgctgaagctagggttgtagtggaacatggcacttatgggaacaggcaggtgttaaagctggacacc

SEQ ID NO: 128145 - DNA, 2955 bp, Homo sapiens
  Payload ID: 5091
  Gene Symbol: DAPP1
  Gene Name: dual adaptor of phosphotyrosine and 3-phosphoinositides
  ENST ID: ENST00000296414
  CDS Start-End: 82-873
gcaggctgctgtctcacagagcgagaaggtgtcaggagcagcccagttgtgtctctctctctacctctgtgaagggcgcgaatgggcagagcagaacttctagaagggaagatgagcacccaggatccctcagatctgtggagcagatccgatggagaggctgagctgctccaggacttggggtggtatcacggcaacctcacacgccatgctgctgaagctcttctcctctcaaatggatgtgacggcagctaccttctgagggacagcaatgagaccaccgggctgtactctctctctgtgagggccaaagattctgttaaacactttcatgttgaatatactggatattcatttaaatttggctttaatgaattctcatctttgaaggattttgtcaagcattttgcaaatcagcctttgattggaagcgagacaggcactctgatggttctaaaacatccctacccaagaaaagtggaagaaccctccatttatgaatctgtccgggttcacacagcaatgcagacaggaagaacagaagatgaccttgtgcccacagcaccttctctgggcaccaaagaaggttacctcaccaaacagggaggcctggtcaagacctggaaaacaagatggtttactctgcacaggaatgaactgaaatacttcaaagaccagatgtcaccagaaccaattcggatcctagacctaacagaatgttcagctgtacaattcgattattcacaagaaagggtaaactgtttttgtttggtatttccattcaggacattttatctctgtgcaaagaccggagtagaagctgatgagtggatcaagatattacgctggaaattggtcaaggacaaaagctgatttattttgtctgctctctgtatatctcccgaggagaagactgatcacaaataagaaaacagctcaaccaaggggaaggcacgatccgatctcggtcgttcatctttaaatagatctttcttgccaaggaatgctctggcccaggagcaaggtggaatgtttccctgacgctgtgatctgcagcaggcttcaaatgaaaaccgactaaggattttctttcaaaaacaaatcagaagcagatgctgattgggacccatataccacgttgctgactcacgttgctgcccttccatgatgttgccatctccttgagaacactgaagcaatcaccattctgatagaaagtgcttaaaccaccactcttaggtctgctcactcttagaacacacaatggaagaggaagggtttttgttttcactcattgtggtccccaagcctattgacactagttgcctagagtcccactgtgagtcatggtcagcctgtctgacatccaggttgtgctattaaccaagaaggaaacagatacttggaggcttagatgacttctgcaggatttatattcagatagaaaacatcaaatattttcaggggagaggtttttttttttaatttttccccctttatacaaaaaaaaaagaacatttccaaaactaaaatagaaaatgcttgtggcatttattttctctttttaaaaggttcagaaatttggcaggtcctttgcttctaatgacaaaactgtgagagctagatgtcctatgggcaattaggtagtataataaaggtaaatgaaggtacaatttttaaaccattattttcaccctgttggggtaaatgttttaaagagtgagaaaacataaattgagaaagggtgataaagtaatagataacttttagtttaataataattattgttattatactactaataatagagcacttgtaagcactaagttatctttatccaacatttctccaaatggactgaaagaaacttttcaaggacagtgtattataacaatccctttcccagaattagttgtatagggttggcccaagagatgtaagaaaaatctcgcattgctccctaagcaccctgggccttattaaagagcaacttctatttccagtcgggggagtaacactaaagctacaagaaatatgtaataatgataggtaataatgtgttccaaagctttttcaaactagaataaggaggcaaatagaagaatgagatactgatgtccacagttcattggcagaatctaaccccttctgttatcttttttaatactatttttgtttagatagaagtttcaaagaagataaaaatgcttgaagagcctgagagtaaaaagattatgctgcaaagctatgatataaactgctcttgcagtccaaagggatacctgattaaagaagtttcttatttaaacatctcagacgcaaaaattacattaaatttttgtatatttcaacaacattttaaatgtattttgttatgtttgtattatataggataaagcaaatgtcaagttaaaatgtattgtgttgtttgtaaagtaagaagttactggccaggagcggcggctcatgcctgtaatcccaggactttggtaggccaagacaagcagatcacttgaggtcaggagttcaacatcagcctggccaacatgatgaaaccttgtctttactaaaaatacaaaaattagctgggcatggtggcaggcgcctgtaatcccagctactcaggaggctgaggcaggagaattgcttgaacccgggaggtggaggttgcagtgaaccaagatcgcggcgctgcactctagcctgggtgacagagtcagactccgtcccaaaaaaacaaacaaacaaaacaaaacaaaaaaaaacagaagttacaaatgaatactcacggatatgtatagttttatgtttgttttcttagaaacaaatgtgtttctttgggtgggtaatattgtgttttactatgtttaccttttataaaacataacctgtttatttatattctttggctttgtttattaaaaagcatgattttgctgtgcatgtaccattttg

SEQ ID NO: 128146 - DNA, 1440 bp, Homo sapiens
  Payload ID: 5091
  Gene Symbol: DAPP1
  Gene Name: dual adaptor of phosphotyrosine and 3-phosphoinositides
  Uniprot ID: Q9UN19
  ENST ID: ENST00000512369
  CDS Start-End: 69-911
tcacagagcgagaaggtgtcaggagcagcccagttgtgtctctctctctacctctgtgaagggcgcgaatgggcagagcagaacttctagaagggaagatgagcacccaggatccctcagatctgtggagcagatccgatggagaggctgagctgctccaggacttggggtggtatcacggcaacctcacacgccatgctgctgaagctcttctcctctcaaatggatgtgacggcagctaccttctgagggacagcaatgagaccaccgggctgtactctctctctgtgagggccaaagattctgttaaacactttcatgttgaatatactggatattcatttaaatttggctttaatgaattctcatctttgaaggattttgtcaagcattttgcaaatcagcctttgattggaagcgagacaggcactctgatggttctaaaacatccctacccaagaaaagtggaagaaccctccatttatgaatctgtccgggttcacacagcaatgcagacaggaagaacagaagatgaccttgtgcccacagcaccttctctgggcaccaaagaaggttacctcaccaaacagggaggcctggtcaagacctggaaaacaagatggtttactctgcacaggaatgaactgaaatacttcaaagaccagatgtcaccagaaccaattcggatcctagacctaacagaatgttcagctgtacaattcgattattcacaagaaagggtaaactgtttttgtttggtatttccattcaggacattttatctctgtgcaaagaccggagtagaagctgatgagtggatcaagatattacgctggaaattgtcacaaataagaaaacagctcaaccaaggggaaggcacgatccgatctcggtcgttcatctttaaatagatctttcttgccaaggaatgctctggcccaggagcaaggtggaatgtttccctgacgctgtgatctgcagcaggcttcaaatgaaaaccgactaaggattttctttcaaaaacaaatcagaagcagatgctgattgggacccatataccacgttgctgactcacgttgctgcccttccatgatgttgccatctccttgagaacactgaagcaatcaccattctgatagaaagtgcttaaaccaccactcttaggtctgctcactcttagaacacacaatggaagaggaagggtttttgttttcactcattgtggtccccaagcctattgacactagttgcctagagtcccactgtgagtcatggtcagcctgtctgacatccaggttgtgctattaaccaagaaggaaacagatacttggaggcttagatgacttctgcaggatttatattcagatagaaaacatcaaatattttcaggggagaggtttttttttttaatttttccccctttatacaaaaaaaaaagaa

SEQ ID NO: 128147 - DNA, 5738 bp, Homo sapiens
  Payload ID: 5092
  Gene Symbol: DUOX1
  Gene Name: dual oxidase 1
  Uniprot ID: Q9NRD9
  ENST ID: ENST00000321429
  CDS Start-End: 408-5063
gtggctgagccgagccgggccgtgccttcccctcctcacccccagccccgcccgtcccggcgcagagctgcagaggcaccggacgagagagggctccgcgggcccagctggcagccaggccggagacaagttgcagtcccgggctctggtgacgccgtggccgcagctggaagaggaaaacaaggatcagattggagaagtgatttatctaagatcccacagtggactgggagcagcactgagacctcagcctagtctcctgatccccaagcagggccctgcctaaggaacacactctgcagagtgctgggccaaagcagggttttccaactaatcttagaaggtaaagtccatgaagggtctccattttgggacattctaatccctgagcccctattattttcatcatgggcttctgcctggctctagcatggacacttctggttggggcatggacccctctgggagctcagaaccccatttcgtgggaggtgcagcgatttgatgggtggtacaacaacctcatggagcacagatggggcagcaaaggctcccggctgcagcgcctggtcccagccagctatgcagatggcgtgtaccagcccttgggagaaccccacctgcccaacccccgagaccttagcaacaccatctcaaggggccctgcagggctggcctccctgagaaaccgcacagtgttgggggtcttctttggctatcacgtgctttcagacctggtgagcgtggaaactcccggctgccccgccgagttcctcaacattcgcatcccgcccggagaccccatgttcgaccccgaccagcgcggggacgtggtgctgcccttccagagaagccgctgggaccccgagaccggacggagtcccagcaatccccgggacccggccaaccaggtgacgggctggctggacggcagcgccatctatggttcctcgcattcctggagcgacgcgctgcggagcttctccaggggacagctggcgtcggggcccgaccccgcttttccccgagactcgcagaaccccctgctcatgtgggcggcgcccgaccccgccaccgggcagaacgggccccgggggctgtacgccttcggggcagagagagggaaccgggaacccttcctgcaggcgctgggcctgctctggttccgctaccacaacctgtgggcgcagaggctggcccgccagcacccagactgggaggacgaggagctgttccagcacgcacgcaagagggtcatcgccacctaccagaacatcgctgtgtatgagtggctgcccagcttcctgcagaaaacactcccggagtatacaggataccggccatttctggaccccagcatctcctcagagttcgtggcggcctctgagcagttcctgtccaccatggtgccccctggcgtctacatgagaaatgccagctgccacttccagggggtcatcaatcggaactcaagtgtctccagagctctccgggtctgcaacagctactggagccgtgagcacccaagcctacaaagtgctgaagatgtggatgcactgctgctgggcatggcctcccagatcgcagagcgagaggaccatgtgttggttgaagatgtgcgggatttctggcctgggccactgaagttttcccgcacagaccacctggccagctgcctgcagcggggccgggatctgggcctgccctcttacaccaaggccagggcagcactgggcttgtctcccattacccgctggcaggacatcaaccctgcactctcccggagcaatgacactgtactggaggccacagctgccctgtacaaccaggacttatcctggctagagctgctccctgggggactcctggagagccaccgggaccctggacctctgttcagcaccatcgtccttgaacaatttgtgcggctacgggatggtgaccgctactggtttgagaacaccaggaatgggctgttctccaagaaggagattgaagaaatccgaaataccaccctgcaggacgtgctggtcgctgttatcaacattgaccccagtgctctgcagcccaatgtctttgtctggcataaaggagacccctgtccgcagccgagacagctcagcactgaaggcctgccagcgtgtgctccctctgttgttcgtgactattttgagggcagtggatttggcttcggggtcaccatcgggaccctctgttgcttccctttggtgagcctgctcagtgcctggattgttgcccggctccggatgagaaatttcaagaggctccagggccaggaccgccagagcatcgtgtctgagaagctcgtgggaggcatggaagctttggaatggcaaggccacaaggagccctgccggcccgtgcttgtgtacctgcagcccgggcagatccgtgtggtagatggcaggctcaccgtgctccgcaccatccagctgcagcctccacagaaggtcaacttcgtcctgtccagcaaccgtggacgccgcactctgctgctcaagatccccaaggagtatgacctggtgctgctgtttaacttggaggaagagcggcaggcgctggtggaaaatctccggggagctctgaaggagagcgggttgagcatccaggagtgggagctgcgggagcaggagctgatgagagcagctgtgacacgggagcagcggaggcacctcctggagacctttttcaggcaccttttctcccaggtgctggacatcaaccaggccgacgcagggaccctgcccctggactcctcccagaaggtgcgggaggccctgacctgtgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctctcctgaggaaaagtctcgccttatgttccgcatgtacgactttgatgggaatggcctcatttccaaggatgagttcatcaggatgctgagatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggggtggaggtgcctgaagtcatcaaggacctctgccggcgagcctcctacatcagccaggatatgatctgtccctctcccagagtgagtgcccgctgttcccgcagcgacattgagactgagttgacacctcagagactgcagtgccccatggacacagaccctccccaggagattcggcggaggtttggcaagaaggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacagacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacagtcttacacagtgtgggccatgtggtgaatgtgtacctgttctccatcagccccctcagcgtcctctcttgcctctttcctggcctcttccatgatgatgggtctgagctcccccagaagtattactggtggttcttccagaccgtaccaggcctcacgggggttgtgctgctcctgatcctggccatcatgtatgtctttgcctcccaccacttccgccgccgcagtttccggggcttctggctgacccaccacctctacatcctgctctatgtcctgctcatcatccatggtagctttgccctgatccagctgccccgtttccacatcttcttcctggtcccagcaatcatctatgggggcgacaagctggtgagcctgagccggaagaaggtggagatcagcgtggtgaaggcggagctgctgccctcaggagtgacccacctgcggttccagcggccccagggctttgagtacaagtcagggcagtgggtgcggatcgcttgcctggctctggggaccaccgagtaccaccccttcacactgacctctgcgccccatgaggacacgcttagcctgcacatccgggcagcagggccctggaccactcgcctcagggagatctactcagccccgacgggtgacagatgtgccagatacccaaagctgtaccttgatggaccatttggagagggccaccaggagtggcataagtttgaggtgtcagtgttagtgggagggggcattggggtcaccccttttgcctccatcctcaaagacctggtcttcaagtcatccgtcagctgccaagtgttctgtaagaagatctacttcatctgggtgacgcggacccagcgtcagtttgagtggctggctgacatcatccgagaggtggaggagaatgaccaccaggacctggtgtctgtgcacatctacatcacccagctggctgagaagttcgacctcaggaccactatgctgtacatctgtgagcggcacttccagaaggttctgaaccggagtctattcacaggcctgcgctccatcacccactttggccgtcccccctttgagcccttcttcaactccctgcaggaggtccacccccaggtccggaagatcggggtgtttagctgtggcccccctggcatgaccaagaatgtggaaaaggcctgtcagctcatcaacaggcaggaccggactcacttctcccaccattatgagaacttctaggcccctgcccgggggttctgcccactgcccagttgagcagaggtttgagcccacacctcacctctgttcttcctatttctggctgcctcagccttctctgatttcccacctcccaaccttgttccaggtggccatagtcagtcaccatgtgtgggctcagggacccccaggaccaggatgtgtctcagcctggagaaatggtgggggggcagtgtctagggactagagtgagaagtaggggagctactgatttggggcaaagtgaaacctctgcttccagacttcagaaacaaatctcagaagacaagctgacctgacaagtactatgtgtgtgcatgtctgtatgtgtgttggggcggtgagtgtaaggatgcagtgggagcatggatgctggcatcttagaaccctccctactcccatacctcctcctcttctgggctccccactgtcagacgggctggcaaatgccttgcaggaggtagaggctggacccatggcaagccatttacagaaacccactcggcaccccagtctaacaccacaactaatttcacccaaggttttaagcacgttctttcatcagaccctggcccaatacctatgtatgcaatgctcctcagccctcttctccctgctccagtagtctcccttccaaataaatcacttttctgcctt

SEQ ID NO: 128148 - DNA, 5483 bp, Homo sapiens
  Payload ID: 5092
  Gene Symbol: DUOX1
  Gene Name: dual oxidase 1
  Uniprot ID: Q9NRD9
  ENST ID: ENST00000389037
  CDS Start-End: 155-4810
gcagagctgcagaggcaccggacgagagagggctccgcgggcccagctggcagccaggccggagacaagttgcagtcccgggctctggtgacgccgtggccgcagggtctccattttgggacattctaatccctgagcccctattattttcatcatgggcttctgcctggctctagcatggacacttctggttggggcatggacccctctgggagctcagaaccccatttcgtgggaggtgcagcgatttgatgggtggtacaacaacctcatggagcacagatggggcagcaaaggctcccggctgcagcgcctggtcccagccagctatgcagatggcgtgtaccagcccttgggagaaccccacctgcccaacccccgagaccttagcaacaccatctcaaggggccctgcagggctggcctccctgagaaaccgcacagtgttgggggtcttctttggctatcacgtgctttcagacctggtgagcgtggaaactcccggctgccccgccgagttcctcaacattcgcatcccgcccggagaccccatgttcgaccccgaccagcgcggggacgtggtgctgcccttccagagaagccgctgggaccccgagaccggacggagtcccagcaatccccgggacccggccaaccaggtgacgggctggctggacggcagcgccatctatggttcctcgcattcctggagcgacgcgctgcggagcttctccaggggacagctggcgtcggggcccgaccccgcttttccccgagactcgcagaaccccctgctcatgtgggcggcgcccgaccccgccaccgggcagaacgggccccgggggctgtacgccttcggggcagagagagggaaccgggaacccttcctgcaggcgctgggcctgctctggttccgctaccacaacctgtgggcgcagaggctggcccgccagcacccagactgggaggacgaggagctgttccagcacgcacgcaagagggtcatcgccacctaccagaacatcgctgtgtatgagtggctgcccagcttcctgcagaaaacactcccggagtatacaggataccggccatttctggaccccagcatctcctcagagttcgtggcggcctctgagcagttcctgtccaccatggtgccccctggcgtctacatgagaaatgccagctgccacttccagggggtcatcaatcggaactcaagtgtctccagagctctccgggtctgcaacagctactggagccgtgagcacccaagcctacaaagtgctgaagatgtggatgcactgctgctgggcatggcctcccagatcgcagagcgagaggaccatgtgttggttgaagatgtgcgggatttctggcctgggccactgaagttttcccgcacagaccacctggccagctgcctgcagcggggccgggatctgggcctgccctcttacaccaaggccagggcagcactgggcttgtctcccattacccgctggcaggacatcaaccctgcactctcccggagcaatgacactgtactggaggccacagctgccctgtacaaccaggacttatcctggctagagctgctccctgggggactcctggagagccaccgggaccctggacctctgttcagcaccatcgtccttgaacaatttgtgcggctacgggatggtgaccgctactggtttgagaacaccaggaatgggctgttctccaagaaggagattgaagaaatccgaaataccaccctgcaggacgtgctggtcgctgttatcaacattgaccccagtgctctgcagcccaatgtctttgtctggcataaaggagacccctgtccgcagccgagacagctcagcactgaaggcctgccagcgtgtgctccctctgttgttcgtgactattttgagggcagtggatttggcttcggggtcaccatcgggaccctctgttgcttccctttggtgagcctgctcagtgcctggattgttgcccggctccggatgagaaatttcaagaggctccagggccaggaccgccagagcatcgtgtctgagaagctcgtgggaggcatggaagctttggaatggcaaggccacaaggagccctgccggcccgtgcttgtgtacctgcagcccgggcagatccgtgtggtagatggcaggctcaccgtgctccgcaccatccagctgcagcctccacagaaggtcaacttcgtcctgtccagcaaccgtggacgccgcactctgctgctcaagatccccaaggagtatgacctggtgctgctgtttaacttggaggaagagcggcaggcgctggtggaaaatctccggggagctctgaaggagagcgggttgagcatccaggagtgggagctgcgggagcaggagctgatgagagcagctgtgacacgggagcagcggaggcacctcctggagacctttttcaggcaccttttctcccaggtgctggacatcaaccaggccgacgcagggaccctgcccctggactcctcccagaaggtgcgggaggccctgacctgtgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctctcctgaggaaaagtctcgccttatgttccgcatgtacgactttgatgggaatggcctcatttccaaggatgagttcatcaggatgctgagatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggggtggaggtgcctgaagtcatcaaggacctctgccggcgagcctcctacatcagccaggatatgatctgtccctctcccagagtgagtgcccgctgttcccgcagcgacattgagactgagttgacacctcagagactgcagtgccccatggacacagaccctccccaggagattcggcggaggtttggcaagaaggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacagacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacagtcttacacagtgtgggccatgtggtgaatgtgtacctgttctccatcagccccctcagcgtcctctcttgcctctttcctggcctcttccatgatgatgggtctgagctcccccagaagtattactggtggttcttccagaccgtaccaggcctcacgggggttgtgctgctcctgatcctggccatcatgtatgtctttgcctcccaccacttccgccgccgcagtttccggggcttctggctgacccaccacctctacatcctgctctatgtcctgctcatcatccatggtagctttgccctgatccagctgccccgtttccacatcttcttcctggtcccagcaatcatctatgggggcgacaagctggtgagcctgagccggaagaaggtggagatcagcgtggtgaaggcggagctgctgccctcaggagtgacccacctgcggttccagcggccccagggctttgagtacaagtcagggcagtgggtgcggatcgcttgcctggctctggggaccaccgagtaccaccccttcacactgacctctgcgccccatgaggacacgcttagcctgcacatccgggcagcagggccctggaccactcgcctcagggagatctactcagccccgacgggtgacagatgtgccagatacccaaagctgtaccttgatggaccatttggagagggccaccaggagtggcataagtttgaggtgtcagtgttagtgggagggggcattggggtcaccccttttgcctccatcctcaaagacctggtcttcaagtcatccgtcagctgccaagtgttctgtaagaagatctacttcatctgggtgacgcggacccagcgtcagtttgagtggctggctgacatcatccgagaggtggaggagaatgaccaccaggacctggtgtctgtgcacatctacatcacccagctggctgagaagttcgacctcaggaccactatgctgtacatctgtgagcggcacttccagaaggttctgaaccggagtctattcacaggcctgcgctccatcacccactttggccgtcccccctttgagcccttcttcaactccctgcaggaggtccacccccaggtccggaagatcggggtgtttagctgtggcccccctggcatgaccaagaatgtggaaaaggcctgtcagctcatcaacaggcaggaccggactcacttctcccaccattatgagaacttctaggcccctgcccgggggttctgcccactgcccagttgagcagaggtttgagcccacacctcacctctgttcttcctatttctggctgcctcagccttctctgatttcccacctcccaaccttgttccaggtggccatagtcagtcaccatgtgtgggctcagggacccccaggaccaggatgtgtctcagcctggagaaatggtgggggggcagtgtctagggactagagtgagaagtaggggagctactgatttggggcaaagtgaaacctctgcttccagacttcagaaacaaatctcagaagacaagctgacctgacaagtactatgtgtgtgcatgtctgtatgtgtgttggggcggtgagtgtaaggatgcagtgggagcatggatgctggcatcttagaaccctccctactcccatacctcctcctcttctgggctccccactgtcagacgggctggcaaatgccttgcaggaggtagaggctggacccatggcaagccatttacagaaacccactcggcaccccagtctaacaccacaactaatttcacccaaggttttaagcacgttctttcatcagaccctggcccaatacctatgtatgcaatgctcctcagccctcttctccctgctccagtagtctcccttccaaataaatcacttttctgcc

SEQ ID NO: 128149 - DNA, 4705 bp, Homo sapiens
  Payload ID: 5092
  Gene Symbol: DUOX1
  Gene Name: dual oxidase 1
  ENST ID: ENST00000561220
  CDS Start-End: 111-1445
agctggcagccaggccggagacaagttgcagtcccgggctctggtgacgccgtggccgcagggtctccattttgggacattctaatccctgagcccctattattttcatcatgggcttctgcctggctctagcatggacacttctggttggggcatggacccctctgggagctcagaaccccatttcgtgggaggtgcagcgatttgatgggtggtacaacaacctcatggagcacagatggggcagcaaaggctcccggctgcagcgcctggtcccagccagctatgcagatggcgtgtaccagcccttgggagaaccccacctgcccaacccccgagaccttagcaacaccatctcaaggggccctgcagggctggcctccctgagaaaccgcacagtgttgggggtcttctttggctatcacgtgctttcagacctggtgagcgtggaaactcccggctgccccgccgagttcctcaacattcgcatcccgcccggagaccccatgttcgaccccgaccagcgcggggacgtggtgctgcccttccagagaagccgctgggaccccgagaccggacggagtcccagcaatccccgggacccggccaaccaggtgacgggctggctggacggcagcgccatctatggttcctcgcattcctggagcgacgcgctgcggagcttctccaggggacagctggcgtcggggcccgaccccgcttttccccgagactcgcagaaccccctgctcatgtgggcggcgcccgaccccgccaccgggcagaacgggccccgggggctgtacgccttcggggcagagagagggaaccgggaacccttcctgcaggcgctgggcctgctctggttccgctaccacaacctgtgggcgcagaggctggcccgccagcacccagactgggaggacgaggagctgttccagcacgcacgcaagagggtcatcgccacctaccagaacatcgctgtgtatgagtggctgcccagcttcctgcagaaaacactcccggagtatacaggataccggccatttctggaccccagcatctcctcagagttcgtggcggcctctgagcagttcctgtccaccatggtgccccctggcgtctacatgagaaatgccagctgccacttccagggggtcatcaatcggaactcaagtgtctccagagctctccgggtctgcaacagctactggagccgtgagcacccaagcctacaaagtgctgaagatgtggatgcactgctgctgggcatggcctcccagatcgcagagcgagaggaccatgtgttggttgaagatgtgcggggtactggaggccacagctgccctgtacaaccaggacttatcctggctagagctgctccctgggggactcctggagagccaccgggaccctggacctctgttcagcaccatcgtccttgaacaatttgtgcggctacgggatggtgaccgctactggtttgagaacaccaggaatgggctgttctccaagaaggagattgaagaaatccgaaataccaccctgcaggacgtgctggtcgctgttatcaacattgaccccagtgctctgcagcccaatgtctttgtctggcataaagcacctgtggcccagcacccaggacgctggcttcctctgccttcccaggagacccctgtccgcagccgagacagctcagcactgaaggcctgccagcgtgtgctccctctgttgttcgtgactattttgagggcagtggatttggcttcggggtcaccatcgggaccctctgttgcttccctttggtgagcctgctcagtgcctggattgttgcccggctccggatgagaaatttcaagaggctccagggccaggaccgccagagcatcgtgtctgagaagctcgtgggaggcatggaagctttggaatggcaaggccacaaggagccctgccggcccgtgcttgtgtacctgcagcccgggcagatccgtgtggtagatggcaggctcaccgtgctccgcaccatccagctgcagcctccacagaaggtcaacttcgtcctgtccagcaaccgtggacgccgcactctgctgctcaagatccccaaggagtatgacctggtgctgctgtttaacttggaggaagagcggcaggcgctggtggaaaatctccggggagctctgaaggagagcgggttgagcatccaggagtgggagctgcgggagcaggagctgatgagagcagctgtgacacgggagcagcggaggcacctcctggagacctttttcaggcaccttttctcccaggtgctggacatcaaccaggccgacgcagggaccctgcccctggactcctcccagaaggtgcgggaggccctgacctgtgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctctcctgaggaaaagtctcgccttatgttccgcatgtacgactttgatgggaatggcctcatttccaaggatgagttcatcaggatgctgagatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggggtggaggtgcctgaagtcatcaaggacctctgccggcgagcctcctacatcagccaggatatgatctgtccctctcccagagtgagtgcccgctgttcccgcagcgacattgagactgagttgacacctcagagactgcagtgccccatggacacagaccctccccaggagattcggcggaggtttggcaagaaggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacagacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacagtcttacacagtgtgggccatgtggtgaatgtgtacctgttctccatcagccccctcagcgtcctctcttgcctctttcctggcctcttccatgatgatgggtctgagctcccccagaagtattactggtggttcttccagaccgtaccaggcctcacgggggttgtgctgctcctgatcctggccatcatgtatgtctttgcctcccaccacttccgccgccgcagtttccggggcttctggctgacccaccacctctacatcctgctctatgtcctgctcatcatccatggtagctttgccctgatccagctgccccgtttccacatcttcttcctggtcccagcaatcatctatgggggcgacaagctggtgagcctgagccggaagaaggtggagatcagcgtggtgaaggcggagctgctgccctcaggagtgacccacctgcggttccagcggccccagggctttgagtacaagtcagggcagtgggtgcggatcgcttgcctggctctggggaccaccgagtaccaccccttcacactgacctctgcgccccatgaggacacgcttagcctgcacatccgggcagcagggccctggaccactcgcctcagggagatctactcagccccgacgggtgacagatgtgccagatacccaaagctgtaccttgatggaccatttggagagggccaccaggagtggcataagtttgaggtgtcagtgttagtgggagggggcattggggtcaccccttttgcctccatcctcaaagacctggtcttcaagtcatccgtcagctgccaagtgttctgtaagaagatctacttcatctgggtgacgcggacccagcgtcagtttgagtggctggctgacatcatccgagaggtggaggagaatgaccaccaggacctggtgtctgtgcacatctacatcacccagctggctgagaagttcgacctcaggaccactatgctgtacatctgtgagcggcacttccagaaggttctgaaccggagtctattcacaggcctgcgctccatcacccactttggccgtcccccctttgagcccttcttcaactccctgcaggaggtccacccccaggtccggaagatcggggtgtttagctgtggcccccctggcatgaccaagaatgtggaaaaggcctgtcagctcatcaacaggcaggaccggactcacttctcccaccattatgagaacttctaggcccctgcccgggggttctgcccactgcccagttgagcagaggtttgagcccacacctcacctct

SEQ ID NO: 128150 - DNA, 4539 bp, Homo sapiens
  Payload ID: 5092
  Gene Symbol: DUOX1
  Gene Name: dual oxidase 1
  Uniprot ID: Q9NRD9
  ENST ID: ENST00000561166
  CDS Start-End: 274-3867
aaggtcaaagtaaaattttaagatcccttgtgcttgtatagacctctgtcaggcagcactgacagaggggacacccctcaccctgagtggggaatcaacctgcagaagaggaatgtcccaccggtttgggagcaaacagcaggactgggtgggctcagggataaggatgatggtgtggagggagccggctgtctaacctctgaccccattaaccacacccctttcctccccacccccaacctataaagcacccaagcctacaaagtgctgaagatgtggatgcactgctgctgggcatggcctcccagatcgcagagcgagaggaccatgtgttggttgaagatgtgcggggtgagtctgaggctgtccctgcaggttgtgaactcctggcctctgggaagaggctcagctggacttccagaaccagatttctggcctgggccactgaagttttcccgcacagaccacctggccagctgcctgcagcggggccgggatctgggcctgccctcttacaccaaggccagggcagcactgggcttgtctcccattacccgctggcaggacatcaaccctgcactctcccggagcaatgacactgtactggaggccacagctgccctgtacaaccaggacttatcctggctagagctgctccctgggggactcctggagagccaccgggaccctggacctctgttcagcaccatcgtccttgaacaatttgtgcggctacgggatggtgaccgctactggtttgagaacaccaggaatgggctgttctccaagaaggagattgaagaaatccgaaataccaccctgcaggacgtgctggtcgctgttatcaacattgaccccagtgctctgcagcccaatgtctttgtctggcataaaggagacccctgtccgcagccgagacagctcagcactgaaggcctgccagcgtgtgctccctctgttgttcgtgactattttgagggcagtggatttggcttcggggtcaccatcgggaccctctgttgcttccctttggtgagcctgctcagtgcctggattgttgcccggctccggatgagaaatttcaagaggctccagggccaggaccgccagagcatcgtgtctgagaagctcgtgggaggcatggaagctttggaatggcaaggccacaaggagccctgccggcccgtgcttgtgtacctgcagcccgggcagatccgtgtggtagatggcaggctcaccgtgctccgcaccatccagctgcagcctccacagaaggtcaacttcgtcctgtccagcaaccgtggacgccgcactctgctgctcaagatccccaaggagtatgacctggtgctgctgtttaacttggaggaagagcggcaggcgctggtggaaaatctccggggagctctgaaggagagcgggttgagcatccaggagtgggagctgcgggagcaggagctgatgagagcagctgtgacacgggagcagcggaggcacctcctggagacctttttcaggcaccttttctcccaggtgctggacatcaaccaggccgacgcagggaccctgcccctggactcctcccagaaggtgcgggaggccctgacctgtgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctctcctgaggaaaagtctcgccttatgttccgcatgtacgactttgatgggaatggcctcatttccaaggatgagttcatcaggatgctgagatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggggtggaggtgcctgaagtcatcaaggacctctgccggcgagcctcctacatcagccaggatatgatctgtccctctcccagagtgagtgcccgctgttcccgcagcgacattgagactgagttgacacctcagagactgcagtgccccatggacacagaccctccccaggagattcggcggaggtttggcaagaaggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacagacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacagtcttacacagtgtgggccatgtggtgaatgtgtacctgttctccatcagccccctcagcgtcctctcttgcctctttcctggcctcttccatgatgatgggtctgagctcccccagaagtattactggtggttcttccagaccgtaccaggcctcacgggggttgtgctgctcctgatcctggccatcatgtatgtctttgcctcccaccacttccgccgccgcagtttccggggcttctggctgacccaccacctctacatcctgctctatgtcctgctcatcatccatggtagctttgccctgatccagctgccccgtttccacatcttcttcctggtcccagcaatcatctatgggggcgacaagctggtgagcctgagccggaagaaggtggagatcagcgtggtgaaggcggagctgctgccctcaggagtgacccacctgcggttccagcggccccagggctttgagtacaagtcagggcagtgggtgcggatcgcttgcctggctctggggaccaccgagtaccaccccttcacactgacctctgcgccccatgaggacacgcttagcctgcacatccgggcagcagggccctggaccactcgcctcagggagatctactcagccccgacgggtgacagatgtgccagatacccaaagctgtaccttgatggaccatttggagagggccaccaggagtggcataagtttgaggtgtcagtgttagtgggagggggcattggggtcaccccttttgcctccatcctcaaagacctggtcttcaagtcatccgtcagctgccaagtgttctgtaagaagatctacttcatctgggtgacgcggacccagcgtcagtttgagtggctggctgacatcatccgagaggtggaggagaatgaccaccaggacctggtgtctgtgcacatctacatcacccagctggctgagaagttcgacctcaggaccactatgctgtacatctgtgagcggcacttccagaaggttctgaaccggagtctattcacaggcctgcgctccatcacccactttggccgtcccccctttgagcccttcttcaactccctgcaggaggtccacccccaggtccggaagatcggggtgtttagctgtggcccccctggcatgaccaagaatgtggaaaaggcctgtcagctcatcaacaggcaggaccggactcacttctcccaccattatgagaacttctaggcccctgcccgggggttctgcccactgcccagttgagcagaggtttgagcccacacctcacctctgttcttcctatttctggctgcctcagccttctctgatttcccacctcccaaccttgttccaggtggccatagtcagtcaccatgtgtgggctcagggacccccaggaccaggatgtgtctcagcctggagaaatggtgggggggcagtgtctagggactagagtgagaagtaggggagctactgatttggggcaaagtgaaacctctgcttccagacttcagaaacaaatctcagaagacaagctgacctgacaagtactatgtgtgtgcatgtctgtatgtgtgttggggcggtgagtgtaaggatgcagtgggagcatggatgctggcatcttagaaccctccctactcccatacctcctcctcttctgggctccccactgtcagacgggctggcaaatgccttgcaggaggtagaggctggacccatggcaagccatttacagaaacccactcggcaccccagtctaacaccacaactaatttcacccaaggttttaagcacgttctttcatcagaccctggcccaatacctatgtatgcaatgctcctcagccctcttctccctgctccagtagtctcccttccaaataaatcacttttctgc

SEQ ID NO: 128151 - DNA, 436 bp, Homo sapiens
  Payload ID: 5092
  Gene Symbol: DUOX1
  Gene Name: dual oxidase 1
  ENST ID: ENST00000558322
  CDS Start-End: 308-436
agagagggctccgcgggcccagctggcagccaggccggagacaagttgcagtcccgggctctggtgacgccgtggccgcagctggaagaggaaaacaaggatcagattggagaagtgatttatctaagatcccacagtggactgggagcagcactgagacctcagcctagtctcctgatccccaagcagggccctgcctaaggaacacactctgcagagtgctgggccaaagcagggttttccaactaatcttagaagggtctccattttgggacattctaatccctgagcccctattattttcatcatgggcttctgcctggctctagcatggacacttctggttggggcatggacccctctgggagctcagaaccccatttcgtgggaggtgcagcgatttgatgggtggtacaacaacctcatggagcacaga

SEQ ID NO: 128152 - DNA, 6533 bp, Homo sapiens
  Payload ID: 5093
  Gene Symbol: DUOX2
  Gene Name: dual oxidase 2
  ENST ID: ENST00000389039
  CDS Start-End: 387-5033
ggttctgcgggttggcgctgagtttggaagtcgcgcgggaccccttttatagcagcgtgggcgacgtgccacacgggtgtcccagcccaggggctggtctgagctggaagaggttgtgcaaataagggccccacctccacggcaggagggtgagccctaggtccagatgctcacactggcgcaggtctgtcctgagccgacacctgcacagtggcgagaccaaggacccagagagaaaggtgagagtgcagccggggaggctgaggatcggcggagctggaagagtgagggtgaaggcaagaagtagagcacagaagcaaagattttaagaggaaagaagacatctgaacccaacaccaccctaaaccacaggctgcagggttggcatgctccgtgcaagaccagaggcactgatgctcctgggagctcttctgactggatccctgggtccatcgggcagtcaggacgcactctcactgccctgggaagtgcagcgctatgacggctggtttaacaacctgaggcaccacgagcgtggtgctgttggctgccggttgcagcgccgcgtaccagccaattacgccgacggtgtgtatcaggctctggaggagccgcagctgcccaacccgcgccggctcagcaacgcagccacgcggggcatagccggcctgccgtcgctccacaaccgcaccgtactgggggtcttctttggctaccatgttctttccgacgtggtgagcgtggaaacgcccggttgccccgccgagttcctcaacatccgcatcccacctggagaccccgtgttcgaccccgaccagcgcggggacgtggtgctgcccttccagaggagccgctgggaccccgagaccggacggagtcccagcaacccccgggacctggccaaccaggtgacgggctggctggacggcagcgccatctatggctcctcgcactcctggagcgacgcgctgcggagcttctcggggggacagctggcgtcggggcccgaccccgctttcccccgagactcgcagaaccccctgctcatgtgggcggcgcccgaccccgccaccgggcagaacgggccccgggggctgtacgccttcggggcagagagagggaaccgggaacccttcctgcaggcgctgggcctgctctggttccgctaccacaacctgtgggcgcagaggctggcccgccagcacccagactgggaggacgaggagctgttccagcacgcacgcaagagggtcatcgccacctaccagaacatcgctgtgtatgagtggctgcccagcttcctgcagaaaacactcccggagtatacaggataccgtcctttcctagaccccagcatctccccggaatttgtggtggcctctgagcagttcttctctaccatggtgccccctggtgtctacatgagaaatgccagctgtcatttccggaaggtcctgaacaagggttttcaaagctcccaagctctcagggtctgcaacaactactggattcgggagaaccccaatctgaacagtacccaggaggtgaatgagctgctgctgggaatggcctcccagatttcggagttggaggacaacatagtggttgaagatctgagggattactggcctggccctggcaaattctcccgtacagactatgtggccagcagcatccaacgtggccgagatatggggctgcccagctatagccaggccctgctggcctttgggctggacatcccaaggaactggagtgatctcaaccctaatgtggacccccaggtgctggaggccacagctgccctgtacaaccaggacctatcccagctagagctgctccttggggggctcctggagagccatggggaccctggacccctgttcagtgccattgtcctcgaccagtttgtacggctgcgggatggtgaccgctactggtttgagaacaccaggaatgggctgttctccaagaaggagattgaagacatccgaaataccaccctgcgggacgtgctggtcgctgttatcaacattgaccccagtgccctgcagcccaatgtctttgtctggcataaaggtgcaccctgccctcaacctaagcagctcacaactgacggcctgccccagtgtgcacccctgactgtgcttgacttctttgaaggcagcagccctggttttgccatcaccatcattgctctctgctgccttcccttagtgagtctgcttctctctggagtggtggcctatttccggggccgagaacacaagaagctacaaaagaaactcaaagagagcgtgaagaaggaagcagccaaagatggagtgccagcgatggagtggccaggccccaaggagaggagcagtcccatcatcatccagctgctgtcagacaggtgtctgcaggtcctgaacaggcatctcactgtgctccgtgtggtccagctgcagcctctgcagcaggtcaacctcatcctgtccaacaaccgaggatgccgcaccctgctgctcaagatccctaaggagtatgacctggtgctgctgtttagttctgaagaggaacggggcgcctttgtgcagcagctatgggacttctgcgtgcgctgggctctgggcctccatgtggctgagatgagcgagaaggagctatttaggaaggctgtgacaaagcagcagcgggaacgcatcctggagatcttcttcagacacctttttgctcaggtgctggacatcaaccaggccgacgcagggaccctgcccctggactcctcccagaaggtgcgggaggccctgacctgcgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctccccagaggataagtcccgtctaatgtttaccatgtatgacctggatgagaatggcttcctctccaaggacgaattcttcaccatgatgcgatccttcatcgagatctccaacaactgcctgtccaaggcccagctggccgaggtggtggagtctatgttccgggagtcgggattccaggacaaggaggagctgacatgggaggattttcacttcatgctgcgggaccatgacagcgagctccgcttcacgcagctctgtgtcaaaggtggaggtggaggtggaaatggtattagagatatctttaaacaaaacatcagctgtcgagtctcgttcatcactcggacacctggggagcgctcccacccccagggactggggccccctgccccagaagccccagagctgggaggccctggactgaagaagaggtttggcaaaaaggcagcagtgcccactccccggctgtacacagaggcgctgcaagagaagatgcagcgaggcttcctagcccaaaagctgcagcagtacaagcgcttcgtggagaactaccggaggcacatcgtgtgtgtggcaatcttctcggccatctgtgttggcgtgtttgcagatcgtgcttactactatggctttgcctcgccaccctcggacattgcacagaccaccctcgtgggcatcatcctgtcacgaggcacggcggccagcgtctccttcatgttctcttatatcttgctcaccatgtgccgcaacctcataaccttcctgcgagagactttcctcaaccgctatgtgccttttgatgccgcagtggacttccaccgctggatcgccatggctgctgttgtcctggccattttgcacagtgctggccacgcagtcaatgtctacatcttctcagtcagcccactcagcctgctggcctgcatattccccaacgtctttgtgaatgatgggtccaagcttccccagaagttctattggtggttcttccagaccgtcccaggtatgacaggtgtgcttctgctcctggtcctggccatcatgtatgtcttcgcctcccaccacttccgccgccgcagcttccggggcttctggctgacccaccacctctacatcctgctctatgccctgctcatcatccatggcagctatgctctgatccagctgcccactttccacatctacttcctggtcccggcaatcatctatggaggtgacaagctggtgagcctgagccggaagaaggtggagatcagcgtggtgaaggcggagctgctgccctcaggagtgacctacctgcaattccagaggccccaaggctttgagtacaagtcaggacagtgggtgcggatcgcctgcctggctctggggaccaccgagtaccaccccttcacactgacctccgcgccccatgaggacacactcagcctgcacatccgggcagtggggccctggaccactcgcctcagggagatctactcatccccaaagggcaatggctgtgctggatacccaaagctgtaccttgatggaccgtttggagagggccatcaggagtggcataaatttgaggtgtcagtgttggtgggagggggcattggggtcaccccctttgcctccatcctcaaagacctggtcttcaagtcatccttgggcagccaaatgctgtgtaagaagatctacttcatctgggtgacacggacccagcgtcagtttgagtggctggctgacatcatccaagaggtggaggagaacgaccaccaggacctggtgtctgtgcacatttatgtcacccagctggctgagaagttcgacctcaggaccaccatgctatacatctgcgagcggcacttccagaaagtgctgaaccggagtctgttcacgggcctgcgctccatcacccactttggccgtccccccttcgagcccttcttcaactccctgcaggaggtccacccacaggtgcgcaagatcggggtgttcagctgcggccctccaggaatgaccaagaatgtagagaaggcctgtcagctcgtcaacaggcaggaccgagcccacttcatgcaccactatgagaacttctgagcctgtcctccctggctgctgcttccagtatcctgccttctcttctgtgcacctaagttgcccagccctgctggcaatctctccatcagaatccaccttaggcctcagctggagggctgcagagcccctcccaatattgggagaatattgacccagacaattatacaaatgagaaaaggcaggagactatgttctacaattgcagtgcatgatgattataagtccacctgtttatcaacggcaccattcctgcagccctccagacttcctgcccttagcaagtgcgcaaccagtcaggatctcccaaagaagataaagaccactcctcaccccagctcaagccatggcaggcgtggcaagcaaagtggggaggagacagtccctgcttgtgacaagtgtggaggtgaaaaggtacaatagtgcttgtctccgatagctccccacatctctaattgacttccacaaaatcgatgcgttgctttggtatttgcttggactgacatttgagggaggaggaggctgggatcctctggctgagaatctcctcagagcccagtgcagaagctgtgatgcttagaacctggacagcccgactgcctcaactctgtctccaggtctattccctccagctccaaaaggagcagccctacttctaccccttcccgtccccaaagtgtcagcaactttgaggagggcaccaggaaacaaagatgcctccccagccctgatattcttgatgtcaccagtgatacccactgccctgacccctgggcaggcccctctctgcatctactggagtggtccctgggctctggggctgaaggattccagcctctctgccagatattcagtactcgatctcaattcccctcttccacaagagttgggtgaccagctgtcctagtttgcccaggactctccctgttttagcactgaaagtctcttgccccaggaaaccccatcagtcccaggcagattgggacagctggtcaccttacgcaagagccaggctgaaacatcccctccatactcagctctttaacttttcttttcctttttcatcgggctctttcctaaaaagctgagctgtaaaatattttacatcgaggtataataaataatcatgtacatgttttaccaccacccaggtcaagacatagaatgtttcaacatttccatcaccccagaaactccccttgtacccccttccacttcgtctcccctagctcctagaagcaaccactgatgtgatttctaccaaatccagttttggtcctactaaatatactcttttgagactggcctcttttactcaccataatgcctttgtaattcatccatgctgttgtgtgtatcagcagtttgttccttttcattgctgagtagtattctattgtagagatgtaccacagtttgtttattcttctgttgatggacgtttgggttgtttctaattttgaatgattataaataaaaattctgtgagtgttcttgtaccta

SEQ ID NO: 128153 - DNA, 6345 bp, Homo sapiens
  Payload ID: 5093
  Gene Symbol: DUOX2
  Gene Name: dual oxidase 2
  Uniprot ID: Q9NRD8
  ENST ID: ENST00000603300
  CDS Start-End: 204-4850
ggtctgtcctgagccgacacctgcacagtggcgagaccaaggacccagagagaaaggtgagagtgcagccggggaggctgaggatcggcggagctggaagagtgagggtgaaggcaagaagtagagcacagaagcaaagattttaagaggaaagaagacatctgaacccaacaccaccctaaaccacaggctgcagggttggcatgctccgtgcaagaccagaggcactgatgctcctgggagctcttctgactggatccctgggtccatcgggcaatcaggacgcactctcactgccctgggaagtgcagcgctatgacggctggtttaacaacctgaggcaccacgagcgtggtgctgttggctgccggttgcagcgccgcgtaccagccaattacgccgacggtgtgtatcaggctctggaggagccgcagctgcccaacccgcgccggctcagcaacgcagccacgcggggcatagccggcctgccgtcgctccacaaccgcaccgtactgggggtcttctttggctaccatgttctttccgacgtggtgagcgtggaaacgcccggttgccccgccgagttcctcaacatccgcatcccacctggagaccccgtgttcgaccccgaccagcgcggggacgtggtgctgcccttccagaggagccgctgggaccccgagaccggacggagtcccagcaacccccgggacctggccaaccaggtgacgggctggctggacggcagcgccatctatggctcctcgcactcctggagcgacgcgctgcggagcttctcggggggacagctggcgtcggggcccgaccccgctttcccccgagactcgcagaaccccctgctcatgtgggcggcgcccgaccccgccaccgggcagaacgggccccgggggctgtacgccttcggggcagagagagggaaccgggaacccttcctgcaggcgctgggcctgctctggttccgctaccacaacctgtgggcgcagaggctggcccgccagcacccagactgggaggacgaggagctgttccagcacgcacgcaagagggtcatcgccacctaccagaacatcgctgtgtatgagtggctgcccagcttcctgcagaaaacactcccggagtatacaggataccgtcctttcctagaccccagcatctccccggaatttgtggtggcctctgagcagttcttctctaccatggtgccccctggtgtctacatgagaaatgccagctgtcatttccggaaggtcctgaacaagggttttcaaagctcccaagctctcagggtctgcaacaactactggattcgggagaaccccaatctgaacagtacccaggaggtgaatgagctgctgctgggaatggcctcccagatttcggagttggaggacaacatagtggttgaagatctgagggattactggcctggccctggcaaattctcccgtacagactatgtggccagcagcatccaacgtggccgagatatggggctgcccagctatagccaggccctgctggcctttgggctggacatcccaaggaactggagtgatctcaaccctaatgtggacccccaggtgctggaggccacagctgccctgtacaaccaggacctatcccagctagagctgctccttggggggctcctggagagccatggggaccctggacccctgttcagtgccattgtcctcgaccagtttgtacggctgcgggatggtgaccgctactggtttgagaacaccaggaatgggctgttctccaagaaggagattgaagacatccgaaataccaccctgcgggacgtgctggtcgctgttatcaacattgaccccagtgccctgcagcccaatgtctttgtctggcataaaggtgcaccctgccctcaacctaagcagctcacaactgacggcctgccccagtgtgcacccctgactgtgcttgacttctttgaaggcagcagccctggttttgccatcaccatcattgctctctgctgccttcccttagtgagtctgcttctctctggagtggtggcctatttccggggccgagaacacaagaagctacaaaagaaactcaaagagagcgtgaagaaggaagcagccaaagatggagtgccagcgatggagtggccaggccccaaggagaggagcagtcccatcatcatccagctgctgtcagacaggtgtctgcaggtcctgaacaggcatctcactgtgctccgtgtggtccagctgcagcctctgcagcaggtcaacctcatcctgtccaacaaccgaggatgccgcaccctgctgctcaagatccctaaggagtatgacctggtgctgctgtttagttctgaagaggaacggggcgcctttgtgcagcagctatgggacttctgcgtgcgctgggctctgggcctccatgtggctgagatgagcgagaaggagctatttaggaaggctgtgacaaagcagcagcgggaacgcatcctggagatcttcttcagacacctttttgctcaggtgctggacatcaaccaggccgacgcagggaccctgcccctggactcctcccagaaggtgcgggaggccctgacctgcgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctccccagaggataagtcccgtctaatgtttaccatgtatgacctggatgagaatggcttcctctccaaggacgaattcttcaccatgatgcgatccttcatcgagatctccaacaactgcctgtccaaggcccagctggccgaggtggtggagtctatgttccgggagtcgggattccaggacaaggaggagctgacatgggaggattttcacttcatgctgcgggaccatgacagcgagctccgcttcacgcagctctgtgtcaaaggtggaggtggaggtggaaatggtattagagatatctttaaacaaaacatcagctgtcgagtctcgttcatcactcggacacctggggagcgctcccacccccagggactggggccccctgccccagaagccccagagctgggaggccctggactgaagaagaggtttggcaaaaaggcagcagtgcccactccccggctgtacacagaggcgctgcaagagaagatgcagcgaggcttcctagcccaaaagctgcagcagtacaagcgcttcgtggagaactaccggaggcacatcgtgtgtgtggcaatcttctcggccatctgtgttggcgtgtttgcagatcgtgcttactactatggctttgcctcgccaccctcggacattgcacagaccaccctcgtgggcatcatcctgtcacgaggcacggcggccagcgtctccttcatgttctcttatatcttgctcaccatgtgccgcaacctcataaccttcctgcgagagactttcctcaaccgctatgtgccttttgatgccgcagtggacttccaccgctggatcgccatggctgctgttgtcctggccattttgcacagtgctggccacgcagtcaatgtctacatcttctcagtcagcccactcagcctgctggcctgcatattccccaacgtctttgtgaatgatgggtccaagcttccccagaagttctattggtggttcttccagaccgtcccaggtatgacaggtgtgcttctgctcctggtcctggccatcatgtatgtcttcgcctcccaccacttccgccgccgcagcttccggggcttctggctgacccaccacctctacatcctgctctatgccctgctcatcatccatggcagctatgctctgatccagctgcccactttccacatctacttcctggtcccggcaatcatctatggaggtgacaagctggtgagcctgagccggaagaaggtggagatcagcgtggtgaaggcggagctgctgccctcaggagtgacctacctgcaattccagaggccccaaggctttgagtacaagtcaggacagtgggtgcggatcgcctgcctggctctggggaccaccgagtaccaccccttcacactgacctccgcgccccatgaggacacactcagcctgcacatccgggcagtggggccctggaccactcgcctcagggagatctactcatccccaaagggcaatggctgtgctggatacccaaagctgtaccttgatggaccgtttggagagggccatcaggagtggcataaatttgaggtgtcagtgttggtgggagggggcattggggtcaccccctttgcctccatcctcaaagacctggtcttcaagtcatccttgggcagccaaatgctgtgtaagaagatctacttcatctgggtgacacggacccagcgtcagtttgagtggctggctgacatcatccaagaggtggaggagaacgaccaccaggacctggtgtctgtgcacatttatgtcacccagctggctgagaagttcgacctcaggaccaccatgctatacatctgcgagcggcacttccagaaagtgctgaaccggagtctgttcacgggcctgcgctccatcacccactttggccgtccccccttcgagcccttcttcaactccctgcaggaggtccacccacaggtgcgcaagatcggggtgttcagctgcggccctccaggaatgaccaagaatgtagagaaggcctgtcagctcgtcaacaggcaggaccgagcccacttcatgcaccactatgagaacttctgagcctgtcctccctggctgctgcttccagtatcctgccttctcttctgtgcacctaagttgcccagccctgctggcaatctctccatcagaatccaccttaggcctcagctggagggctgcagagcccctcccaatattgggagaatattgacccagacaattatacaaatgagaaaaggcaggagactatgttctacaattgcagtgcatgatgattataagtccacctgtttatcaacggcaccattcctgcagccctccagacttcctgcccttagcaagtgcgcaaccagtcaggatctcccaaagaagataaagaccactcctcaccccagctcaagccatggcaggcgtggcaagcaaagtggggaggagacagtccctgcttgtgacaagtgtggaggtgaaaaggtacaatagtgcttgtctccgatagctccccacatctctaattgacttccacaaaatcgatgcgttgctttggtatttgcttggactgacatttgagggaggaggaggctgggatcctctggctgagaatctcctcagagcccagtgcagaagctgtgatgcttagaacctggacagcccgactgcctcaactctgtctccaggtctattccctccagctccaaaaggagcagccctacttctaccccttcccgtccccaaagtgtcagcaactttgaggagggcaccaggaaacaaagatgcctccccagccctgatattcttgatgtcaccagtgatacccactgccctgacccctgggcaggcccctctctgcatctactggagtggtccctgggctctggggctgaaggattccagcctctctgccagatattcagtactcgatctcaattcccctcttccacaagagttgggtgaccagctgtcctagtttgcccaggactctccctgttttagcactgaaagtctcttgccccaggaaaccccatcagtcccaggcagattgggacagctggtcaccttacgcaagagccaggctgaaacatcccctccatactcagctctttaacttttcttttcctttttcatcgggctctttcctaaaaagctgagctgtaaaatattttacatcgaggtataataaataatcatgtacatgttttaccaccacccaggtcaagacatagaatgtttcaacatttccatcaccccagaaactccccttgtacccccttccacttcgtctcccctagctcctagaagcaaccactgatgtgatttctaccaaatccagttttggtcctactaaatatactcttttgagactggcctcttttactcaccataatgcctttgtaattcatccatgctgttgtgtgtatcagcagtttgttccttttcattgctgagtagtattctattgtagagatgtaccacagtttgtttattcttctgttgatggacgtttgggttgtttctaattttgaatgattataaataaaaattctgtgagtgttcttgt

SEQ ID NO: 128154 - DNA, 1996 bp, Homo sapiens
  Payload ID: 5094
  Gene Symbol: DUOXA1
  Gene Name: dual oxidase maturation factor 1
  Uniprot ID: Q1HG43
  ENST ID: ENST00000267803
  CDS Start-End: 401-1852
cgcgcgaggtgagacggcgagggctcccggggcgcaggtagagatgttccgtcggtgccgaaggcccggctagtgcggttgtgtggacggcgaaaaaaaccaggccaggcgtcaaagcaagtcacccatccgacctaaacccctctaagaccccggagtcacgtctccctccggggatcctcgtgaggtcttgggggtcccaccgccctgcgagccgcgcccgcgccccgccagacccggaactgcgtcgctagaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggctgtgaatttcagttctgagtggtctgtgggccaggtcagcaccaacacatcatacaaggccttcagttctgagtggatcagcgctgatattgggctgcaggtcgggctgggtggagtcaacatcacactcacagggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatgggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactatcgccccaggagactttccctggtgcctgcggatgtccgaggcctcgcgccagcagcgctcagtgcccttcctggagctctcctggcccaggcctggcgggcactgcttcccggcctgcgatgtcccaaggcggggaaggagtccagattgggtccccctcacagtccttggcgctttggtccagaagggtgcgaagagcgctgggccgaacatactggagactcaccacggcccctccgaggaagaggcacaggacgcctgtggcggtggggatcgaaagaaaggagggcatgtggagtcagggctatgttgcccaggctggtctcgaactctggcctcaaacgaccttcctgcctcgacctcccaaagtgctgggattacaggcgtgatgcccgggccttcttccatcttttggagcctaccccttgtgttacctcccgccacacacctctaatctgaattacatgaaacacggcaagacaccaaacccttctgagccccccacttttcatctgtaaaatggtcataacagtgcctgtttctgcgaactattgagaggggcaaatagggtaatagatgtgaattcattctgtaaactggaaa

SEQ ID NO: 128155 - DNA, 1317 bp, Homo sapiens
  Payload ID: 5094
  Gene Symbol: DUOXA1
  Gene Name: dual oxidase maturation factor 1
  ENST ID: ENST00000430224
  CDS Start-End: 1-1317
atggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatgggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactatcgccccaggagactttccctggtgcctgcggatgtccgaggcctcgcgccagcagcgctcagtgcccttcctggagctctcctggcccaggcctggcgggcactgcttcccggcctgcgatgtcccaaggcggggaaggagtccagattgggtccccctcacagtccttggcgctttggtccagaagggtgcgaagagcgctgggccgaacatactggagactcaccacggcccctccgaggaagaggcacaggacgcctgtggcggtggggatcgaaagaaaggagggcatgtggagtcagggctatgttgcccaggctggtctcgaactctggcctcaaacgaccttcctgcctcgacctcccaaagtgctgggattacaggcgtgatgcccgggccttcttccatcttttggagcctaccccttgtgttacctcccgccacacacctctaatctga

SEQ ID NO: 128156 - DNA, 572 bp, Homo sapiens
  Payload ID: 5094
  Gene Symbol: DUOXA1
  Gene Name: dual oxidase maturation factor 1
  ENST ID: ENST00000559226
  CDS Start-End: 358-572
gcttccagcggacggcagcgcgcgaggtgagacggcgagggctcccggggcgcagaccaggccaggcgtcaaagcaagtcacccatccgacctaaacccctctaagaccccggagtcacgtctccctccggggatcctcgtgaggtcttgggggtcccaccgccctgcgagccgcgcccgcgccccgccagacccggaactgcgtcgctagaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggggacccccgt

SEQ ID NO: 128157 - DNA, 641 bp, Homo sapiens
  Payload ID: 5094
  Gene Symbol: DUOXA1
  Gene Name: dual oxidase maturation factor 1
  ENST ID: ENST00000559644
  CDS Start-End: 595-641
agccacggggcggggcgcagtggggcgggatggagtctggcgcctggggaggcgcggaggtgcttccagcggacggcagcgcgcgagaccaggccaggcgtcaaagcaagtcacccatccgacctaaacccctctaagaccccggagtcacgtctccctccggggatcctcgtgaggtcttgggggtcccaccgccctgcgagccgcgcccgcgccccgccagacccggaactgcgtcgctagcccttctctgtaccaggccgggagagggaggcggcgccgcagagcctcgggtgcagtctgagaagtttgggagtgacttgaagagtgactggaagcaccccagacccggtttgtccggtcacagccgggtccttacgtgagttaggagaggagtgggggtcggacgggagccccactgagagtaagggcgcgcgtttgttcacagaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctggccccaagcc

SEQ ID NO: 128158 - DNA, 532 bp, Homo sapiens
  Payload ID: 5094
  Gene Symbol: DUOXA1
  Gene Name: dual oxidase maturation factor 1
  ENST ID: ENST00000558851
  CDS Start-End: 495-532
agcgcgcgaggtgagacggcgagggctcccggggcgcaggtagagatgttccgtcggtgccgaaggcccggctagtgcggttgtgtggacggcgaaaaaaaccaggccaggcgtcaaagcaagtcacccatccgacctaaacccctctaagaccccggagtcacgtctccctccggggatcctcgtgaggtcttgggggtcccaccgccctgcgagccgcgcccgcgccccgccagacccggaactgcgtcgctaggccgggagagggaggcggcgccgcagagcctcgggtgcagtctgagaagtttgggagtgacttgaagagtgactggaagcaccccagacccgaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctgg

SEQ ID NO: 128159 - DNA, 578 bp, Homo sapiens
  Payload ID: 5094
  Gene Symbol: DUOXA1
  Gene Name: dual oxidase maturation factor 1
  ENST ID: ENST00000558377
  CDS Start-End: 361-578
atggagtctggcgcctggggaggcgcggaggtgcttccagcggacggcagcgcgcgagaccaggccaggcgtcaaagcaagtcacccatccgacctaaacccctctaagaccccggagtcacgtctccctccggggatcctcgtgaggtcttgggggtcccaccgccctgcgagccgcgcccgcgccccgccagacccggaactgcgtcgctagaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggctgtgaatttcag

SEQ ID NO: 128160 - DNA, 1965 bp, Homo sapiens
  Payload ID: 5094
  Gene Symbol: DUOXA1
  Gene Name: dual oxidase maturation factor 1
  Uniprot ID: Q1HG43
  ENST ID: ENST00000559014
  CDS Start-End: 373-1824
agcgcgcgaggtgagacggcgagggctcccggggcgcagtccaaggccatcgatcacctgccacccacagaccaggccaggcgtcaaagcaagtcacccatccgacctaaacccctctaagaccccggagtcacgtctccctccggggatcctcgtgaggtcttgggggtcccaccgccctgcgagccgcgcccgcgccccgccagacccggaactgcgtcgctagaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggctgtgaatttcagttctgagtggtctgtgggccaggtcagcaccaacacatcatacaaggccttcagttctgagtggatcagcgctgatattgggctgcaggtcgggctgggtggagtcaacatcacactcacagggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatgggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactatcgccccaggagactttccctggtgcctgcggatgtccgaggcctcgcgccagcagcgctcagtgcccttcctggagctctcctggcccaggcctggcgggcactgcttcccggcctgcgatgtcccaaggcggggaaggagtccagattgggtccccctcacagtccttggcgctttggtccagaagggtgcgaagagcgctgggccgaacatactggagactcaccacggcccctccgaggaagaggcacaggacgcctgtggcggtggggatcgaaagaaaggagggcatgtggagtcagggctatgttgcccaggctggtctcgaactctggcctcaaacgaccttcctgcctcgacctcccaaagtgctgggattacaggcgtgatgcccgggccttcttccatcttttggagcctaccccttgtgttacctcccgccacacacctctaatctgaattacatgaaacacggcaagacaccaaacccttctgagccccccacttttcatctgtaaaatggtcataacagtgcctgtttctgcgaactattgagaggggcaaatagggtaatagatgtgaattcattctgtaaactgg

SEQ ID NO: 128161 - DNA, 1568 bp, Homo sapiens
  Payload ID: 5094
  Gene Symbol: DUOXA1
  Gene Name: dual oxidase maturation factor 1
  ENST ID: ENST00000559013
  CDS Start-End: 1-500
acaccactttggccagcatcatcatgatctttctgactgcactggccacgttcatcgtcatcctgcctggcattcggggaaagacgaggctgttctggctgcttcgggtggtgaccagcttattcatcggggctgcaatcctggctgtgaatttcagttctgagtggtctgtgggccaggtcagcaccaacacatcatacaaggccttcagttctgagtggatcagcgctgatattgggctgcaggtcgggctgggtggagtcaacatcacactcacagggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatgcaggtagaagtacctgggccagtcctcactgggtcctggctctccagggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactgtaaggaggcacaccccaaagatcctgattgtgctttataacattcctccccgtggaggccacctggacttccagtctggctccaaacctcattggcgccccataaaaccagcagaactgccctcagggtggctgttaccagacacccagcaccaatctacagacggagtagaaaaaggaggctctatatactgatgttaaaaaacaaaacaaaacaaaaagccctaagggactgaagagatgctgggcctgtccataaagcctgttgccatgataaggccaagcaggggctagcttatctgcacagcaacccagcctttccgtgctgccttgcctcttcaagatgctattcactgaaacctaacttcacccccataacaccagcagggtgggggttacatatgattctcctatggtttcctctcatccctcggcacctcttgttttcctttttcctgggttccttttgttcttcctttacttctccagcttgtgtggccttttggtacaatgaaagacagcactggaaaggaggggaaaccaaacttctcatcctaggtctaacattaaccaactatgccacattctctt

SEQ ID NO: 128162 - DNA, 441 bp, Homo sapiens
  Payload ID: 5094
  Gene Symbol: DUOXA1
  Gene Name: dual oxidase maturation factor 1
  ENST ID: ENST00000559988
  CDS Start-End: 78-441
gcggacggcagcgcgcgaggtgagacggcgagggctcccggggcgcagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggctgtgaatttcagttctgagtggtctgtgggccaggtcagcaccaacacatcatacaaggccttcagttctgagtggatcagcgctgatattgggctgcaggtcgggctgggtggagtcaacatcacactcacagggacccccgtgcagcagctgaatg

SEQ ID NO: 128163 - DNA, 1678 bp, Homo sapiens
  Payload ID: 5094
  Gene Symbol: DUOXA1
  Gene Name: dual oxidase maturation factor 1
  Uniprot ID: Q1HG43
  ENST ID: ENST00000558422
  CDS Start-End: 397-1293
gcttccagcggacggcagcgcgcgagaccaggccaggcgtcaaagcaagtcacccatccgacctaaacccctctaagaccccggagtcacgtctccctccggggatcctcgtgaggtcttgggggtcccaccgccctgcgagccgcgcccgcgccccgccagacccggaactgcgtcgctagaacgtcgggacctggttccctctttaatcacacccccgggggcgcttcgtgtgaggttccacgggggaaggcgagaggcgcaggctgccacacacgcactgtttggaagaggggaagggctgcacttcctgctttcatccagaccaagttcggatcaagtgggagttcttcaaagagagagtttgcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatgggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactgtaaggaggcacaccccaaagatcctgattgtgctttataacattcctccccgtggaggccacctggacttccagtctggctccaaacctcattggcgccccataaaaccagcagaactgccctcagggtggctgttaccagacacccagcaccaatctacagacggagtagaaaaaggaggctctatatactgatgttaaaaaacaaaacaaaacaaaaagccctaagggactgaagagatgctgggcctgtccataaagcctgttgccatgataaggccaagcaggggctagcttatctgcacagcaacccagcctttccgtgctgccttgcctcttcaagatgctattcactgaaacctaacttcacccccataacaccagcagggtgggggttacatatgattctcctatggtttcctctca

SEQ ID NO: 128164 - DNA, 2684 bp, Homo sapiens
  Payload ID: 5094
  Gene Symbol: DUOXA1
  Gene Name: dual oxidase maturation factor 1
  Uniprot ID: Q1HG43
  ENST ID: ENST00000558996
  CDS Start-End: 56-952
gcttccagcggacggcagcgcgcgagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatgggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactgtaaggaggcacaccccaaagatcctgattgtgctttataacattcctccccgtggaggccacctggacttccagtctggctccaaacctcattggcgccccataaaaccagcagaactgccctcagggtggctgttaccagacacccagcaccaatctacagacggagtagaaaaaggaggctctatatactgatgttaaaaaacaaaacaaaacaaaaagccctaagggactgaagagatgctgggcctgtccataaagcctgttgccatgataaggccaagcaggggctagcttatctgcacagcaacccagcctttccgtgctgccttgcctcttcaagatgctattcactgaaacctaacttcacccccataacaccagcagggtgggggttacatatgattctcctatggtttcctctcatccctcggcacctcttgttttcctttttcctgggttccttttgttcttcctttacttctccagcttgtgtggccttttggtacaatgaaagacagcactggaaaggaggggaaaccaaacttctcatcctaggtctaacattaaccaactatgccacattctctttgagcttcagttcccaaatttgctacataagattgcaagacttgccaagaatcttgggatttatctttctatgccttgctgacacctaccttggccctcaaacaccacctcacaagaagccaggtgggaagttagggaatcaactccaaaacgctattccttcccaccccactcagctgggctagctgagtggcatccaggacgggggagtgggtgacctgcctcatcactgccacctaacgtccccctggggtggttcagaaagatgctagctctggtagggtccctccggcctcactagagggcgcccctattactctggagtcgacgcagagaatcaggtttcacagcactgcggagagtgtactaggctgtctccagcccagcgaagctcatgaggacgtgcgaccccggcgcggagaagccatgaaaattaatgggaaaaacagtttttaaaaaacaaaagaaaaaaaggtttatttacagatcgccccaggagactttccctggtgcctgcggatgtccgaggcctcgcgccagcagcgctcagtgcccttcctggagctctcctggcccaggcctggcgggcactgcttcccggcctgcgatgtcccaaggcggggaaggagtccagattgggtccccctcacaggttagtggtgatacattttaagtctgggagagcggcctgcttgtgcagtgggtcgccgaggataagaggtgagccccctctctcctggctgcagtccttggcgctttggtccagaagggtgcgaagagcgctgggccgaacatactggagactcaccacggcccctccgaggaagaggcacaggacgcctgtggcggtggggatcgaaagaaaggagggcatgtggagtcagggctatgttgcccaggctggtctcgaactctggcctcaaacgaccttcctgcctcgacctcccaaagtgctgggattacaggcgtgatgcccgggccttcttccatcttttggagcctaccccttgtgttacctcccgccacacacctctaatctgaattacatgaaacacggcaagacaccaaacccttctgagccccccacttttcatctgtaaaatggtcataacagtgcctgtttctgcgaactattgagaggggcaaatagggtaatagatgtgaattcattctgtaaactgg

SEQ ID NO: 128165 - DNA, 1044 bp, Homo sapiens
  Payload ID: 5094
  Gene Symbol: DUOXA1
  Gene Name: dual oxidase maturation factor 1
  Uniprot ID: Q1HG43
  ENST ID: ENST00000560572
  CDS Start-End: 7-1038
accaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggctgtgaatttcagttctgagtggtctgtgggccaggtcagcaccaacacatcatacaaggccttcagttctgagtggatcagcgctgatattgggctgcaggtcgggctgggtggagtcaacatcacactcacagggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatgggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactgtaaggaggcacaccccaaagatcctgattgtgctttataacattcc

SEQ ID NO: 128166 - DNA, 562 bp, Homo sapiens
  Payload ID: 5094
  Gene Symbol: DUOXA1
  Gene Name: dual oxidase maturation factor 1
  ENST ID: ENST00000558326
  CDS Start-End: 331-562
gtgcttccagcggacggcagcgcgcgagaccaggccaggcgtcaaagcaagtcacccatccgacctaaacccctctaagaccccggagtcacgtctccctccggggatcctcgtgaggtcttgggggtcccaccgccctgcgagccgcgcccgcgccccgccagacccggaactgcgtcgctagaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggggacccccgtgcagcagctgaatgaga

SEQ ID NO: 128167 - DNA, 1867 bp, Homo sapiens
  Payload ID: 5094
  Gene Symbol: DUOXA1
  Gene Name: dual oxidase maturation factor 1
  ENST ID: ENST00000613425
  CDS Start-End: 403-1719
agcgcgcgaggtgagacggcgagggctcccggggcgcaggtagagatgttccgtcggtgccgaaggcccggctagtgcggttgtgtggacggcgaaaaaaaccaggccaggcgtcaaagcaagtcacccatccgacctaaacccctctaagaccccggagtcacgtctccctccggggatcctcgtgaggtcttgggggtcccaccgccctgcgagccgcgcccgcgccccgccagacccggaactgcgtcgctagaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatgggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactatcgccccaggagactttccctggtgcctgcggatgtccgaggcctcgcgccagcagcgctcagtgcccttcctggagctctcctggcccaggcctggcgggcactgcttcccggcctgcgatgtcccaaggcggggaaggagtccagattgggtccccctcacagtccttggcgctttggtccagaagggtgcgaagagcgctgggccgaacatactggagactcaccacggcccctccgaggaagaggcacaggacgcctgtggcggtggggatcgaaagaaaggagggcatgtggagtcagggctatgttgcccaggctggtctcgaactctggcctcaaacgaccttcctgcctcgacctcccaaagtgctgggattacaggcgtgatgcccgggccttcttccatcttttggagcctaccccttgtgttacctcccgccacacacctctaatctgaattacatgaaacacggcaagacaccaaacccttctgagccccccacttttcatctgtaaaatggtcataacagtgcctgtttctgcgaactattgagaggggcaaatagggtaatagatgtgaattcattctgtaaactggaaagtgc

SEQ ID NO: 128168 - DNA, 1760 bp, Homo sapiens
  Payload ID: 5095
  Gene Symbol: DUOXA2
  Gene Name: dual oxidase maturation factor 2
  Uniprot ID: Q1HG44
  ENST ID: ENST00000323030
  CDS Start-End: 286-1248
aactcagcgccaacccgcagaaccaggaaagtaacggctacagacagtgagaaatagtttcgctcgccggctagaaaaactctgtcggtaccaaccccagagcgttgagagcagcccacctccacgcttccttaacggagaggtgcaggactcagacttcaccagcccactcggtcccagccttgtacgcaaagagacgccaaggacgcgctctcccgcgtccaggcagccccagcttgctggcttgcctgcccgcctgcgtgcagcactcggccggcgtgcagcatgaccctgtggaacggcgtactgcctttttacccccagccccggcatgccgcaggcttcagcgttccactgctcatcgttattctagtgtttttggctctagcagcaagcttcctgctcatcttgccggggatccgtggccactcgcgctggttttggttggtgagagttcttctcagtctgttcataggcgcagaaattgtggctgtgcacttcagtgcagaatggttcgtgggtacagtgaacaccaacacatcctacaaagccttcagcgcagcgcgcgttacagcccgtgtccgtctgctcgtgggcctggagggcattaatattacactcacagggaccccagtgcatcagctgaacgagaccattgactacaacgagcagttcacctggcgtctgaaagagaattacgccgcggagtacgcgaacgcactggagaaggggctgccggacccagtgctctacctggcggagaagttcacaccgagtagcccttgcggcctgtaccaccagtaccacctggcgggacactacgcctcggccacgctatgggtggcgttctgcttctggctcctctccaacgtgctgctctccacgccggccccgctctacggaggcctggcactgctgaccaccggagccttcgcgctcttcggggtcttcgccttggcctccatctctagcgtgccgctctgcccgctccgcctaggctcctccgcgctcaccactcagtacggcgccgccttctgggtcacgctggcaaccggcgtcctgtgcctcttcctcggaggggccgtggtgagtctccagtatgttcggcccagcgctcttcgcacccttctggaccaaagcgccaaggactgcagccaggagagagggggctcacctcttatcctcggcgacccactgcacaagcaggccgctctcccagacttaaaatgtatcaccactaacctgtgagggggacccaatctggactccttccccgccttgggacatcgcaggccgggaagcagtgcccgccaggcctgggccaggagagctccaggaagggcactgagcgctgctggcgcgaggcctcggacatccgcaggcaccagggaaagtctcctggggcgatctgtaaataaacctttttttcttttgttttttaaaaactgtttttcccattaattttcatggcttctccgcgccggggtcgcacgtcctcatgagcttcgctgggctggagacagcctagtacactctccgcagtgctgtgaaacctgattctctgcgtcgactccagagtaataggggcgccctctagtgaggccggagggaccctaccagagctagcatctttctgaaccaccccagggggacgttaggtggcagtgatgaggcaggtcacccactcccccgtcctggatgccactcagctagcccagctgagtggggtgggaaggaatagcgttttggagttgattccc

SEQ ID NO: 128169 - DNA, 1724 bp, Homo sapiens
  Payload ID: 5095
  Gene Symbol: DUOXA2
  Gene Name: dual oxidase maturation factor 2
  Uniprot ID: Q1HG44
  ENST ID: ENST00000491993
  CDS Start-End: 133-498
agacttcaccagcccactcggtcccagccttgtacgcaaagagacgccaaggacgcgctctcccgcgtccaggcagccccagcttgctggcttgcctgcccgcctgcgtgcagcactcggccggcgtgcagcatgaccctgtggaacggcgtactgcctttttacccccagccccggcatgccgcaggcttcagcgttccactgctcatcgttattctagtgtttttggctctagcagcaagcttcctgctcatcttgccggggatccgtggccactcggagtatctgcattcccacctcctcccctcggagatcaggctggggcctccctcttctgagggaggtgacccctgcgtgcctagcacttctggactcactgagcctcaccaagcagtgactggaccaggaggcagaaccaggaccaggcgccagacagctaggggagtgaaggtggtggaagagtgccaggaagtgggggtggaggggaggtgctgttagggtagatgggaaatggggctagggaggtgaaagtgcgtggtcacaaaatatcagaaatgccagtagcccagagggacttgcaggaaaagcgtgcctaacattagtctcaaaagtctggatataactaaagatccaggtgaagtggggtcaagggtggtcttggggactctggtttggcagggctcaggcctgacccgggtgcctattcctgcagcgctggttttggttggtgagagttcttctcagtctgttcataggcgcagaaattgtggctgtgcacttcagtgcagaatggttcgtgggtacagtgaacaccaacacatcctacaaagccttcagcgcagcgcgcgttacagcccgtgtccgtctgctcgtgggcctggagggcattaatattacactcacagggaccccagtgcatcagctgaacgagaccattgactacaacgagcagttcacctggcgtctgaaagagaattacgccgcggagtacgcgaacgcactggagaaggggctgccggacccagtgctctacctggcggagaagttcacaccgagtagcccttgcggcctgtaccaccagtaccacctggcgggacactacgcctcggccacgctatgggtggcgttctgcttctggctcctctccaacgtgctgctctccacgccggccccgctctacggaggcctggcactgctgaccaccggagccttcgcgctcttcggggtcttcgccttggcctccatctctagcgtgccgctctgcccgctccgcctaggctcctccgcgctcaccactcagtacggcgccgccttctgggtcacgctggcaaccggcgtcctgtgcctcttcctcggaggggccgtggtgagtctccagtatgttcggcccagcgctcttcgcacccttctggaccaaagcgccaaggactgcagccaggagagagggggctcacctcttatcctcggcgacccactgcacaagcaggccgctctcccagacttaaaatgtatcaccactaacctgtgagggggacccaatctggactccttccccgccttgggacatcgcaggccgggaagcagtgcccgccaggcctgggccaggagagctccaggaagggcactgagcgctgctggcgcgaggcctcggacatccgcaggcaccagggaaagtctcctggggcgatctgtaaataaacctttttttcttttgttttttaaaa

SEQ ID NO: 128170 - DNA, 7739 bp, Homo sapiens
  Payload ID: 5096
  Gene Symbol: DSTYK
  Gene Name: dual serine/threonine and tyrosine protein kinase
  Uniprot ID: Q6XUX3
  ENST ID: ENST00000367161
  CDS Start-End: 32-2686
ccgagccgcaaagacagagcgggcagaggcgatggagggcgacggggtgccatggggcagcgagcccgtctcgggtcccggccccggcggcggcggaatgatccgcgagctgtgccggggcttcggccgctaccgccgctacctgggacggctgcgacagaacctgcgcgagacccagaagttcttccgcgacatcaagtgctcccacaaccacacttgtctctcctccctcacgggcggcggcggggccgagcgcggccctgcaggcgatgtcgccgaaaccgggctgcaggcgggccaactgagctgcatttccttcccacctaaggaagagaagtacctccagcagattgtggactgcctcccttgcatactgatcctcggccaggattgtaacgtcaagtgccagctgttgaatctgctgttgggggtgcaggtgcttcccaccaccaagctgggcagtgaggagagctgtaagcttcggcgcctccgcttcacctatgggactcagactcgggtcagcctggcgctccctggacagtatgaactagtgcacacgctggttgctcatcagggcaactgggagaccatccctgaggaggatctggaggtccaagagaacaatgaggatgctgctcatgttttagcggaactggaggtaacgatgcaccatgctctcttacaggaagtggacgttgtggtagcaccatgccaaggcctccggcccacagtggatgttctgggtgacttggtgaatgatttcttgcctgtgataacctatgcactccacaaagatgaactctctgagagggatgagcaagagcttcaggaaatccgaaagtatttctcctttcctgtattctttttcaaagtgccgaaactgggctcggagataatagactcctcaaccaggagaatggagagcgaaagatcaccgctttatcgccagctaattgacctgggctatctgagcagcagtcactggaactgtggggctcctggccaggatactaaagctcagagcatgttggtggaacagagtgaaaagctgagacacttgagcacattttctcaccaggtgttacagactcgcctggtggatgcagccaaggccctgaacctggtgcactgccactgccttgacatctttattaaccaggcatttgacatgcagcgggacctgcagatcactcccaaacgtctggaatatactcgaaaaaaggagaatgagttgtatgaatcattgatgaatattgccaaccgaaagcaggaggaaatgaaggatatgattgttgagacacttaataccatgaaggaggaacttctggatgatgctactaacatggagtttaaagacgtcattgtccctgagaatggagaaccagtaggcaccagagagatcaaatgctgcatccgacagatccaggaactcatcatctcccgacttaatcaggcagtggctaataagctgatcagctcagtggattacctgagggaaagcttcgtcggaaccctggaacgatgtctgcagagcctggagaagtctcaggatgtctcagttcacatcaccagtaattatctcaaacagatcttaaatgctgcctatcatgttgaagtcacgtttcactcagggtcgtcagttacaaggatgctatgggagcaaatcaaacagatcatccagcgcatcacatgggtgagcccacctgccatcactctggaatggaagaggaaggtggcccaggaagccattgagagcctcagcgcctccaaattggctaagagcatttgcagccaattccggactcggctcaatagttcccacgaggcttttgcagcctccttgcggcagctggaagctggccactcaggccggttagagaaaacggaagatctatggctgagggttcggaaagatcatgctccccgcctggcccgcctttctctggaaagctgttctttacaggatgtcttgcttcatcgtaaacctaaactgggacaggaactgggccggggccagtatggtgtggtatacctgtgtgacaactggggaggacacttcccttgtgccctcaaatcagttgtccctccagatgagaagcactggaatgatctggctttggaatttcactatatgaggtctctgccgaagcatgagcgattggtggatctccatggttcagtcattgactacaactatggtggtggctccagcattgctgtgctcctcattatggagcggctacaccgggatctctacacagggctgaaggctgggctgaccctggagacacgtttgcagatagcactagatgtggtggagggaatccgcttcctgcacagccagggacttgtccatcgtgatatcaaactgaaaaatgtgctgctggataagcagaaccgtgccaagatcactgacttaggattctgcaagccagaggccatgatgtcaggcagcattgtggggacaccaatccatatggcccctgaacttttcacaggggctcgcccagaacgtcttcctgtgtttgatgaggagtgctggcagttgatggaagcctgttgggatggcgaccccttgaagaggcctctcttgggcattgtccagcccatgctccagggcatcatgaatcggctctgcaagtccaattctgagcagccaaacagaggactagatgattctacttgaaagcaaagacctttctctttcactctctagttatttccttccccctcaccttttggccatggggagaatttgacatttattcactataggacacactcccaagggaactggtgcttgctgggaaacttggaaccttcccaggcagggatgactcctggacagtgaagagttgaatgactgagcatattcagcagctcactgaagcgccaagctatccctttagcaaaaaagtgtctcagatgtgtaaaagctgaggaatgtggtgttctggcttcacaaatgaaaaggaggcagatgttaccattgtcttttcactgtatatacttctaagacagcaagcgggacactgcagtggcaatagtgttaaaaaatctcattctcatgatttttggctctagctaggaatagtttagtcaggactcagaaaatttgagcttagttctgggattatgaaaacatggggacaaaaacaataacttgtggatgtctggttcctgctgtctgcagccaggtatctcaggttgcaatggtcagaagtcccagtgagggagctagaaacagagctatctgttcctcatagtgccagtgtgtttacatttataggaccacatatccctggtttctgggggagggtttcactgttacatcaccaagaggccctgaaaagaggaaaaaaaaaaaaaaagaggccaggcatggtggctcacgcctgtaatctcagcactttgggaggctgaggcgggcggatcacaaggtccagagttcaagagcagcctggccaacatggtgaaaccccgtctctactaaagatacaaaaaattagccgggcgtggtggtgcatgcctgtaatccaagatactcaggaggctgaggcaggagaatcgcttgaacctgggaggcggaggttgcagtgagccgagatcatgccattgcactccagcctgggcgacagagtgagactctgtctcaaaaaaaaaaaaaaaatagaatgtgtatgcatatatttgtgtgtatatgtatatatgtgtgtgtgtctatatctctatctatatagacatacacacaggagttattggatttagagttactgctaaccccagaacagaatctgttcttttacctttgagtcttttcttttgtttacctcttttcatctcaaagtgggaaagctccagataacatggtacttaggagtgagtgtctaagcaaaaccaacccaatgcgaagtatttgggtgagaactgagaggtgggagatgattggaggccatggcctatgtacaaacatactggaagaaaaccagcttgtttttaaaacttaacacaatcagaaatttttctttttgtgtttgaatctaacacactgacgtttggaaaacttgatcaatgagcttttaaccacgatttctcccgcaatttgttccttctttttacctttttaaaaatctgttagaagaaaaaaagcagcagacgaaagagaaaaaccctcctctggtagttctgtgtgtgcccctcacccctgtgtgctagtgtctgggaagtttccctgaaaggtgggaggcgggtgggtggtcttttggagggttcctcatgaagtgtgcttgaggaaagaaattctgattctaggcagaggaaggggaacaatttaaatattggtgcatctcagatgcacttgacttcaagccttcctcaaccaaactggtccattagattccgaaaaacaggtagacgaggaagtagacagtggaagtgagtagtctccctccatctgcctaatccccaataactgtggtctggcccctgtgttcagcccgagagtttgtaaaacaggtccccaggtaggtgtataagatgagttgcaaattagccgggcatgctggcacgcaccagtaatcccagctacttgggaggctgaggcaggagaatcacttgaacccgggaggcagaggtcatggtgagccgagatcacgccactgcactccagcctgggcaacagagcgagactctatctcaaaaaaaaacaaaaaaaaaaacaaaaaacaaagatgagtcgcacatctgctgctgggattttctagggttgtctatgacagaatgaccatcttttaaatattaatggagtataaatggagtctataatgggtctttcatataacttttaactctttggctatcctgggctctgatcatgatatgtttgagcatagtagctccctaaactcttggagcctttcagaaattccatgtagtgctaataacctttttacttgcaaatgataaagtaactgactcagtgtctttgggctctgcaggctttagccttgttttggtaggatgttcagtatattctcagaatttttaccacctatttagctatacttcaagtactctattctctgcactaacttactgtccttctgggaactatgatggggcttcaagggagtcaggtgtcaagaaaggaggggtaagtactctctacttgctggaaaatcattgtaagtctgttgtgtatgaaattttaggaaaagtcttatatagttccctttccagactgttttcttttgactctaactataatcataagtctgtgcttccattatgaaggtcacattcctagcattcttgggaagtattagctcatactctcattcacatatgggaggttagatttttttcctctacccagagtccctttttagtttaccccacggcttagtttgctgtcagataccagttctctagcagattccccaacagttttttccccagtggggagggtggaagggagggactgatataagtaaggagatgagtagttgtgttacagttcattttctttaaaaaaaagtattttgagaaaaggtgcaaaatattcttgaaagtctctaggccagccaaagtccacatatggatatttggggatgttatttaaatactcagcaggctgagtgcaggtatacgtgtgtatagagtgtgtatactttgcttttgttttataacattgtcagctaattttggctttgttctttggcatccattcttattataagtgatggaatgccatgaaatgtactgtattgtatattacttgggaggacactaggttttcaaagaagtctggcagcacttgggttatagagggctcagcatgaccaaagtcctaaagattttacctcccagctttggttgtatgtgttcccaagtggtgaggtgagattgtggctggaggaagaaaaaggatggcatgaaagaatgacccttattgtggtctgtccttctaatcaacataattagggcagcttaccccaacatgaaaatgatgacctggccatttttaatggccagagcttgaagtctggtctctcattttgtttcagaaatgagtgagaggccttcctgcagagcagtcaggagaaatggtggagcctggggccctggaatggctgaccctgtgcctagagagctgatggcaagggctgtctggcatggctcatttgggtggggtttccccaggcataccttagttccctgatcctctgcaaagagtagctcattgactgagcaagcgcttcaggaggactgtgctggttgttcccagaccaaagagagtcacttttgactccatcaacttcaaggggacagagcctaggcagcagattctcctaatttttaacactaaaattcaaggaagcagtggaggaaagaatgcattactaccacagatagaaataggggactcatagaactctcgactagtacctgtcagctctcaaatgcattcttgtgtctttgcttgagctgccaaagaagggtcacaaagtgttcttcctcatggaagaagtgcctcggggttgcagggctgcaaagtgacaactgcactgaatgacactttattttttggctttggcttattatttagcactgggaggcccaggggaattggtgattacagtagcactttgggaagttaaagccccctttgggcttgctttggagagatgatggcatgcttggtattccatttggataatcaggaagcctccctagtccatccatattgtgtcagagtgggattaacaaccctggaagagtccactgccaaaagagtagttgctttcctggaatttccaaagcttttggattttctggatcaagtaacccactttttaaaacctgaggtcaggagttcgagaccagcctggtaacatggtgaaaccccgtctctattaaaaatagaaaaaattagccaggcatggtggcgggcacctatagtcccagctactcaggaggctgaggtaggagaattgcttgaacccaggagacagaggctgcattgagccaagatcacaccactgcactccagcctgggcagcagagcaagactccatctcaaaaaaaaaaaaaagaaaaagaaaaagaaggttaatccttcagttatggaggtgggatgaatagagcttgtttgatgttaaagtgggtaaggagggagtggccttgagacacttgtattccaaactctcctggaggtttccagtagcactactgttcctaaaagggtttcatttttaacttcatctgttttgttaacatccagtccaattgaggtgatctcagaggtgcatcaggacatctagcactggggaggccaccttgcccagatagttgaaaagaaaattggtctgggcagcctgttgtcttttgtcttcatgtaatgttttttctttgttttaaaggactaatgtttattacagtgttaaataaaagtgtaagatactaagtgtgtagaataaaagtgcaataacaaaagacaatgactttggcacacacttcagtctttatcctctctcctttcttgtgctacctggctctttccataatattgttacagcaggaccgtcttaattgtgtgcattttgaagagatgcgactctgggttaatcttcattagtgtaatattgaagggttgggtttggttttatagagtattctgtatacttgttgggatacacaaataccagatgtgctgtataataaagatcacattaacgttt

SEQ ID NO: 128171 - DNA, 7874 bp, Homo sapiens
  Payload ID: 5096
  Gene Symbol: DSTYK
  Gene Name: dual serine/threonine and tyrosine protein kinase
  Uniprot ID: Q6XUX3
  ENST ID: ENST00000367162
  CDS Start-End: 32-2821
ccgagccgcaaagacagagcgggcagaggcgatggagggcgacggggtgccatggggcagcgagcccgtctcgggtcccggccccggcggcggcggaatgatccgcgagctgtgccggggcttcggccgctaccgccgctacctgggacggctgcgacagaacctgcgcgagacccagaagttcttccgcgacatcaagtgctcccacaaccacacttgtctctcctccctcacgggcggcggcggggccgagcgcggccctgcaggcgatgtcgccgaaaccgggctgcaggcgggccaactgagctgcatttccttcccacctaaggaagagaagtacctccagcagattgtggactgcctcccttgcatactgatcctcggccaggattgtaacgtcaagtgccagctgttgaatctgctgttgggggtgcaggtgcttcccaccaccaagctgggcagtgaggagagctgtaagcttcggcgcctccgcttcacctatgggactcagactcgggtcagcctggcgctccctggacagtatgaactagtgcacacgctggttgctcatcagggcaactgggagaccatccctgaggaggatctggaggtccaagagaacaatgaggatgctgctcatgttttagcggaactggaggtaacgatgcaccatgctctcttacaggaagtggacgttgtggtagcaccatgccaaggcctccggcccacagtggatgttctgggtgacttggtgaatgatttcttgcctgtgataacctatgcactccacaaagatgaactctctgagagggatgagcaagagcttcaggaaatccgaaagtatttctcctttcctgtattctttttcaaagtgccgaaactgggctcggagataatagactcctcaaccaggagaatggagagcgaaagatcaccgctttatcgccagctaattgacctgggctatctgagcagcagtcactggaactgtggggctcctggccaggatactaaagctcagagcatgttggtggaacagagtgaaaagctgagacacttgagcacattttctcaccaggtgttacagactcgcctggtggatgcagccaaggccctgaacctggtgcactgccactgccttgacatctttattaaccaggcatttgacatgcagcgggacctgcagatcactcccaaacgtctggaatatactcgaaaaaaggagaatgagttgtatgaatcattgatgaatattgccaaccgaaagcaggaggaaatgaaggatatgattgttgagacacttaataccatgaaggaggaacttctggatgatgctactaacatggagtttaaagacgtcattgtccctgagaatggagaaccagtaggcaccagagagatcaaatgctgcatccgacagatccaggaactcatcatctcccgacttaatcaggcagtggctaataagctgatcagctcagtggattacctgagggaaagcttcgtcggaaccctggaacgatgtctgcagagcctggagaagtctcaggatgtctcagttcacatcaccagtaattatctcaaacagatcttaaatgctgcctatcatgttgaagtcacgtttcactcagggtcgtcagttacaaggatgctatgggagcaaatcaaacagatcatccagcgcatcacatgggtgagcccacctgccatcactctggaatggaagaggaaggtggcccaggaagccattgagagcctcagcgcctccaaattggctaagagcatttgcagccaattccggactcggctcaatagttcccacgaggcttttgcagcctccttgcggcagctggaagctggccactcaggccggttagagaaaacggaagatctatggctgagggttcggaaagatcatgctccccgcctggcccgcctttctctggaaagctgttctttacaggatgtcttgcttcatcgtaaacctaaactgggacaggaactgggccggggccagtatggtgtggtatacctgtgtgacaactggggaggacacttcccttgtgccctcaaatcagttgtccctccagatgagaagcactggaatgatctggctttggaatttcactatatgaggtctctgccgaagcatgagcgattggtggatctccatggttcagtcattgactacaactatggtggtggctccagcattgctgtgctcctcattatggagcggctacaccgggatctctacacagggctgaaggctgggctgaccctggagacacgtttgcagatagcactagatgtggtggagggaatccgcttcctgcacagccagggacttgtccatcgtgatatcaaactgaaaaatgtgctgctggataagcagaaccgtgccaagatcactgacttaggattctgcaagccagaggccatgatgtcaggcagcattgtggggacaccaatccatatggcccctgaacttttcacagggaagtacgataattccgtggatgtctacgcttttggaattcttttctggtatatctgctcaggctctgtcaagctccctgaggcatttgagaggtgtgctagcaaagaccatctctggaacaatgtgcggaggggggctcgcccagaacgtcttcctgtgtttgatgaggagtgctggcagttgatggaagcctgttgggatggcgaccccttgaagaggcctctcttgggcattgtccagcccatgctccagggcatcatgaatcggctctgcaagtccaattctgagcagccaaacagaggactagatgattctacttgaaagcaaagacctttctctttcactctctagttatttccttccccctcaccttttggccatggggagaatttgacatttattcactataggacacactcccaagggaactggtgcttgctgggaaacttggaaccttcccaggcagggatgactcctggacagtgaagagttgaatgactgagcatattcagcagctcactgaagcgccaagctatccctttagcaaaaaagtgtctcagatgtgtaaaagctgaggaatgtggtgttctggcttcacaaatgaaaaggaggcagatgttaccattgtcttttcactgtatatacttctaagacagcaagcgggacactgcagtggcaatagtgttaaaaaatctcattctcatgatttttggctctagctaggaatagtttagtcaggactcagaaaatttgagcttagttctgggattatgaaaacatggggacaaaaacaataacttgtggatgtctggttcctgctgtctgcagccaggtatctcaggttgcaatggtcagaagtcccagtgagggagctagaaacagagctatctgttcctcatagtgccagtgtgtttacatttataggaccacatatccctggtttctgggggagggtttcactgttacatcaccaagaggccctgaaaagaggaaaaaaaaaaaaaaagaggccaggcatggtggctcacgcctgtaatctcagcactttgggaggctgaggcgggcggatcacaaggtccagagttcaagagcagcctggccaacatggtgaaaccccgtctctactaaagatacaaaaaattagccgggcgtggtggtgcatgcctgtaatccaagatactcaggaggctgaggcaggagaatcgcttgaacctgggaggcggaggttgcagtgagccgagatcatgccattgcactccagcctgggcgacagagtgagactctgtctcaaaaaaaaaaaaaaaatagaatgtgtatgcatatatttgtgtgtatatgtatatatgtgtgtgtgtctatatctctatctatatagacatacacacaggagttattggatttagagttactgctaaccccagaacagaatctgttcttttacctttgagtcttttcttttgtttacctcttttcatctcaaagtgggaaagctccagataacatggtacttaggagtgagtgtctaagcaaaaccaacccaatgcgaagtatttgggtgagaactgagaggtgggagatgattggaggccatggcctatgtacaaacatactggaagaaaaccagcttgtttttaaaacttaacacaatcagaaatttttctttttgtgtttgaatctaacacactgacgtttggaaaacttgatcaatgagcttttaaccacgatttctcccgcaatttgttccttctttttacctttttaaaaatctgttagaagaaaaaaagcagcagacgaaagagaaaaaccctcctctggtagttctgtgtgtgcccctcacccctgtgtgctagtgtctgggaagtttccctgaaaggtgggaggcgggtgggtggtcttttggagggttcctcatgaagtgtgcttgaggaaagaaattctgattctaggcagaggaaggggaacaatttaaatattggtgcatctcagatgcacttgacttcaagccttcctcaaccaaactggtccattagattccgaaaaacaggtagacgaggaagtagacagtggaagtgagtagtctccctccatctgcctaatccccaataactgtggtctggcccctgtgttcagcccgagagtttgtaaaacaggtccccaggtaggtgtataagatgagttgcaaattagccgggcatgctggcacgcaccagtaatcccagctacttgggaggctgaggcaggagaatcacttgaacccgggaggcagaggtcatggtgagccgagatcacgccactgcactccagcctgggcaacagagcgagactctatctcaaaaaaaaacaaaaaaaaaaacaaaaaacaaagatgagtcgcacatctgctgctgggattttctagggttgtctatgacagaatgaccatcttttaaatattaatggagtataaatggagtctataatgggtctttcatataacttttaactctttggctatcctgggctctgatcatgatatgtttgagcatagtagctccctaaactcttggagcctttcagaaattccatgtagtgctaataacctttttacttgcaaatgataaagtaactgactcagtgtctttgggctctgcaggctttagccttgttttggtaggatgttcagtatattctcagaatttttaccacctatttagctatacttcaagtactctattctctgcactaacttactgtccttctgggaactatgatggggcttcaagggagtcaggtgtcaagaaaggaggggtaagtactctctacttgctggaaaatcattgtaagtctgttgtgtatgaaattttaggaaaagtcttatatagttccctttccagactgttttcttttgactctaactataatcataagtctgtgcttccattatgaaggtcacattcctagcattcttgggaagtattagctcatactctcattcacatatgggaggttagatttttttcctctacccagagtccctttttagtttaccccacggcttagtttgctgtcagataccagttctctagcagattccccaacagttttttccccagtggggagggtggaagggagggactgatataagtaaggagatgagtagttgtgttacagttcattttctttaaaaaaaagtattttgagaaaaggtgcaaaatattcttgaaagtctctaggccagccaaagtccacatatggatatttggggatgttatttaaatactcagcaggctgagtgcaggtatacgtgtgtatagagtgtgtatactttgcttttgttttataacattgtcagctaattttggctttgttctttggcatccattcttattataagtgatggaatgccatgaaatgtactgtattgtatattacttgggaggacactaggttttcaaagaagtctggcagcacttgggttatagagggctcagcatgaccaaagtcctaaagattttacctcccagctttggttgtatgtgttcccaagtggtgaggtgagattgtggctggaggaagaaaaaggatggcatgaaagaatgacccttattgtggtctgtccttctaatcaacataattagggcagcttaccccaacatgaaaatgatgacctggccatttttaatggccagagcttgaagtctggtctctcattttgtttcagaaatgagtgagaggccttcctgcagagcagtcaggagaaatggtggagcctggggccctggaatggctgaccctgtgcctagagagctgatggcaagggctgtctggcatggctcatttgggtggggtttccccaggcataccttagttccctgatcctctgcaaagagtagctcattgactgagcaagcgcttcaggaggactgtgctggttgttcccagaccaaagagagtcacttttgactccatcaacttcaaggggacagagcctaggcagcagattctcctaatttttaacactaaaattcaaggaagcagtggaggaaagaatgcattactaccacagatagaaataggggactcatagaactctcgactagtacctgtcagctctcaaatgcattcttgtgtctttgcttgagctgccaaagaagggtcacaaagtgttcttcctcatggaagaagtgcctcggggttgcagggctgcaaagtgacaactgcactgaatgacactttattttttggctttggcttattatttagcactgggaggcccaggggaattggtgattacagtagcactttgggaagttaaagccccctttgggcttgctttggagagatgatggcatgcttggtattccatttggataatcaggaagcctccctagtccatccatattgtgtcagagtgggattaacaaccctggaagagtccactgccaaaagagtagttgctttcctggaatttccaaagcttttggattttctggatcaagtaacccactttttaaaacctgaggtcaggagttcgagaccagcctggtaacatggtgaaaccccgtctctattaaaaatagaaaaaattagccaggcatggtggcgggcacctatagtcccagctactcaggaggctgaggtaggagaattgcttgaacccaggagacagaggctgcattgagccaagatcacaccactgcactccagcctgggcagcagagcaagactccatctcaaaaaaaaaaaaaagaaaaagaaaaagaaggttaatccttcagttatggaggtgggatgaatagagcttgtttgatgttaaagtgggtaaggagggagtggccttgagacacttgtattccaaactctcctggaggtttccagtagcactactgttcctaaaagggtttcatttttaacttcatctgttttgttaacatccagtccaattgaggtgatctcagaggtgcatcaggacatctagcactggggaggccaccttgcccagatagttgaaaagaaaattggtctgggcagcctgttgtcttttgtcttcatgtaatgttttttctttgttttaaaggactaatgtttattacagtgttaaataaaagtgtaagatactaagtgtgtagaataaaagtgcaataacaaaagacaatgactttggcacacacttcagtctttatcctctctcctttcttgtgctacctggctctttccataatattgttacagcaggaccgtcttaattgtgtgcattttgaagagatgcgactctgggttaatcttcattagtgtaatattgaagggttgggtttggttttatagagtattctgtatacttgttgggatacacaaataccagatgtgctgtataataaagatcacattaacgttt

SEQ ID NO: 128172 - DNA, 1042 bp, Homo sapiens
  Payload ID: 5096
  Gene Symbol: DSTYK
  Gene Name: dual serine/threonine and tyrosine protein kinase
  Uniprot ID: Q6XUX3
  ENST ID: ENST00000615388
  CDS Start-End: 447-986
tttgagacagtctcattctgtcacccaggttggagtgcatggtgtgatctcagttcactgcagcctccgtctcctcggttcaagcaattctcctgcctcagcttcctgagtagctggaattataggtgtgcaccagcatgtctggctaatttttgtattttcagtagagacggggtctccccatattggccaggctggtcttgaactcctgacctcaaacgatctgcccaccccagcctcccaaagtgctgggattacaagtgtgagccaccacacccagcctaatgtaactgttttcctttccttttagtctttatctcattgttatatgtgattataatgttgtcatttatgcagttcacatcaccagtaattatctcaaacagatcttaaatgctgcctatcatgttgaagtcacgtttcactcagggtcgtcagttacaaggatgctatgggagcaaatcaaacagatcatccagcgcatcacatgggtgagcccacctgccatcactctggaatggaagaggaaggtggcccaggaagccattgagagcctcagcgcctccaaattggctaagagcatttgcagccaattccggactcggctcaatagttcccacgaggcttttgcagcctccttgcggcagctggaagctggccactcaggccggttagagaaaacggaagatctatggctgagggttcggaaagatcatgctccccgcctggcccgcctttctctggaaagctgttctttacaggatgtcttgcttcatcgtaaacctaaactgggacaggaactgggccggggccagtatggtgtggtatacctgtgtgacaactggggaggacacttcccttgtgccctcaaatcagttgtccctccagatgagaagcactggaatgatctggctttggaatttcactatatgaggtgggtcctggcctcattcatctctatgagaaagatccagagaagaatctagaaccctggtttagattttgtaccaagagctacagcatggcctctctatatttagtt

SEQ ID NO: 128173 - DNA, 2019 bp, Homo sapiens
  Payload ID: 5097
  Gene Symbol: DUSP1
  Gene Name: dual specificity phosphatase 1
  Uniprot ID: P28562
  ENST ID: ENST00000239223
  CDS Start-End: 244-1347
gcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcatcactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaatttcaa

SEQ ID NO: 128174 - DNA, 2676 bp, Homo sapiens
  Payload ID: 5098
  Gene Symbol: DUSP10
  Gene Name: dual specificity phosphatase 10
  Uniprot ID: Q9Y6W6
  ENST ID: ENST00000366899
  CDS Start-End: 240-1688
ggattcttattggcccaacccgccgtcggtcggcggcgagtccgccccctcagaaccttacatttacagtgtagcaaaagagaaagtaactatgttgctgctggagatcaatgaagccgagtgaatgggggctgaatgtgcgagtccatagctgaagaggagcgccagatggtggaggaatacacttatttatgaaactgtcttgagttcttcttgaattgccagttttcagcctcctcatgcctccgtctcctttagacgacagggtagtagtggcactatctaggcccgtccgacctcaggatctcaacctttgtttagactctagttaccttggctctgccaacccaggcagtaacagccaccctcctgtcatcgccaccaccgttgtgtccctcaaggctgcgaatctgacgtatatgccctcatccagcggctctgcccgctcgctgaattgtggatgcagcagtgccagctgctgcactgtggcaacctacgacaaggacaatcaggcccaaacccaagccattgccgctggcaccaccaccactgccatcggaacctctaccacctgccctgctaaccagatggtcaacaataatgagaatacaggctctctaagtccatcaagtggggtgggcagccctgtgtcagggacccccaagcagctagccagcatcaaaataatctaccccaatgacttggcaaagaagatgaccaaatgcagcaagagtcacctgccgagtcagggccctgtcatcattgactgcaggcccttcatggagtacaacaagagtcacatccaaggagctgtccacattaactgtgccgataagatcagccggcggagactgcagcagggcaagatcactgtcctagacttgatttcctgtagggaaggcaaggactctttcaagaggatcttttccaaagaaattatagtttatgatgagaataccaatgaaccaagccgagtgatgccctcccagccacttcacatagtcctcgagtccctgaagagagaaggcaaagaacctctggtgttgaaaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggattttttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcaaaaaaaaaaaaaatcttggtgtgtttctgttgattgtgtaaaaatttattttcattatataaatgaaactgg

SEQ ID NO: 128175 - DNA, 803 bp, Homo sapiens
  Payload ID: 5098
  Gene Symbol: DUSP10
  Gene Name: dual specificity phosphatase 10
  ENST ID: ENST00000494642
  CDS Start-End: 208-408
gtataaacaaaatagtatgcaacttacagcaatgtctctcccacttataataaaacacctaactctcatgtagcattttatccatattgagagctctgtgagatagaaattattatattacaagtcacagatatgtaaactgagatgcagagacatcaataacttgctcaaggttacaaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtg

SEQ ID NO: 128176 - DNA, 1009 bp, Homo sapiens
  Payload ID: 5098
  Gene Symbol: DUSP10
  Gene Name: dual specificity phosphatase 10
  ENST ID: ENST00000477026
  CDS Start-End: 137-337
aactatgttgctgctggagatcaatgaagccgagtgaatgggggctgaatgtgcgagtccatagctgaagaggagcgccagatggtggaggaatacacttatttatgaagtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatac

SEQ ID NO: 128177 - DNA, 1625 bp, Homo sapiens
  Payload ID: 5098
  Gene Symbol: DUSP10
  Gene Name: dual specificity phosphatase 10
  ENST ID: ENST00000468085
  CDS Start-End: 86-286
attttcgagttggtgagacaccgcggcagtcgacttggaagatgctctggtggtagaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggattttttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcaaaaaaaaaaaaaa

SEQ ID NO: 128178 - DNA, 1653 bp, Homo sapiens
  Payload ID: 5099
  Gene Symbol: DUSP11
  Gene Name: dual specificity phosphatase 11 (RNA/RNP complex 1-interacting)
  Uniprot ID: O75319
  ENST ID: ENST00000272444
  CDS Start-End: 43-1176
agtaagccagcgtggctacgccatcacgaccggcggtggcacatgcgcaatagcgagacgctggagcgcggcgtaggtggctgccgagtcttttcctgtttagggtcttatcctggcattgagggcgccggactggcgcttttggccgacttggcattgggtgggcggcttcttgggacccacatgagccagtggcatcatccccgcagtggctggggccggagacgcgacttttcaggacgctcctcagccaagaagaagggcggaaaccacatccccgaaaggtggaaagactatctcccagttggacagcggatgcctgggactcgtttcattgctttcaaagttcctttgcaaaagagttttgaaaagaaacttgctccagaagaatgcttttcccctttggatctttttaacaaaatccgagaacaaaatgaagaacttggactgattattgatttaacatatactcaacgctattataaaccagaggatttgccagaaactgttccttacttaaaaatttttacagttggacatcaagtgcctgatgatgagactatttttaaattcaaacacgctgttaatgggtttttgaaagaaaataaagataatgataaacttattggtgtccactgtacccatggtttaaacaggactggctacctcatttgcagatatttgattgatgtagaaggcgtgaggccagatgatgcaattgaattattcaataggtgccggggacattgcttagaaagacaaaactacattgaagaccttcagaatggtcctatcagaaagaattggaattccagtgtacccaggtcaagtgattttgaagactcagcacatctcatgcaaccagtccacaataagcctgttaaacaaggacctaggtataatctacatcagatccagggtcactcagctcctcgacatttccacacccagacccaaagtttgcaacaatcagtcagaaaattttcagagaatccacatgtttaccagagacaccatctccctcctcctggtccccctggagaggactattcacacaggaggtattcttggaatgtgaagcccaatgccagtcgggcagcccaggatagaagaaggtggtatccttataattactccagactctcctatccagcctgttgggaatggacccagtgatacaaacctgtcctggaattctacctggagaccagagctggcctgaaaattactggtgtgacttttaattagttcaggtctaatcaggtttctttattgttcccttatgtattcaagcttaaggaaaaattgcattgctgtttacctctttgctgataaatttgcagtaattacagcattgcaggaaaaacaatctgttattccagtcttaaatttttctaaaagaagacaatattttagaactgaagcattgagaacttcccttgcaaattatttttaaaattctatcttgtttttctatgtatttctttctgactagacttgtgatatgcgtgtgtttatgtacagaaatttttagtgtttttgttatgttctgttattgacccaaaggccatctttattttctataactgttcaaaatttatattaaaatctacttaggagataatttctttagaacctagttactacctgtaa

SEQ ID NO: 128179 - DNA, 672 bp, Homo sapiens
  Payload ID: 5099
  Gene Symbol: DUSP11
  Gene Name: dual specificity phosphatase 11 (RNA/RNP complex 1-interacting)
  ENST ID: ENST00000452812
  CDS Start-End: 1-453
cagtggcatcatccccgcagtggctggggccggagacgcgacttttcaggacgctcctcagccaagaagaagggcggaaaccacatccccgaaaggtggaaagactatctcccagttggacagcggatgcctgggactcgtttcattgctttcaaagttcctttgcaaaagagttttgaaaagaaacttgctccagaagaatgcttttcccctttggatctttttaacaaaatccgagaacaaaatgaagaacttggactgattattgatttaacatatactcaacgctattataaaccagaggatttgccagaaactgttccttacttaaaaatttttacagttggacatcaagtgcctgatgatgagactatttttaaattcaaacacgctgttaatgggtttttgaaagaaaataaagataatgaagtgagaagtagaagaaaagattaaaaaactctgagtcttagagttatgtgaaagagacaagaaagggcaaagattaagaatgggacggacccctagaagcaaaacaagaaagagtgcaccagtggaattgcccctttgtcatatgtatttaagacacatgtatacatatgtaacaaacctgcacgttgtgcacatgtaccctaaaacttaaagtataattaaaaaaaagatatttctgctgtt

SEQ ID NO: 128180 - DNA, 2175 bp, Homo sapiens
  Payload ID: 5099
  Gene Symbol: DUSP11
  Gene Name: dual specificity phosphatase 11 (RNA/RNP complex 1-interacting)
  ENST ID: ENST00000443070
  CDS Start-End: 7-828
tggcacatgcgcaatagcgagacgctggagcgcggcgtaggtggctgccgagtcttttcctgtttagggtcttatcctggcattgagggcgccggactggcgcttttggccgacttggcattgggtgggcggcttcttgggacccacatgagccagtggcatcatccccgcagtggctggggccggagacgcgacttttcaggacgctcctcagccaagaagaagggcggaaaccacatccccgaaaggtggaaagactatctcccagttggacagcggatgcctgggactcgtttcattgctttcaaagttcctttgcaaaagagttttgaaaagaaacttgctccagaagaatgcttttcccctttggatctttttaacaaaatccgagaacaaaatgaagaacttggactgattattgatttaacatatactcaacgctattataaaccagaggatttgccagaaactgttccttacttaaaaatttttacagttggacatcaagtgcctgatgatgagactatttttaaattcaaacacgctgttaatgggtttttgaaagaaaataaagataatgataaacttattggtgtccactgtacccatggtttaaacaggactggctacctcatttgcagacggagtcttgctctgtcacccaggctggagtgcagtggcaccatctcgactcactccaagttctgcttcccaggttcacgccgttctcctgcctcagcctcccaagtagctgggactacaggtgcccgccaccacgcccggctaattttttgtatttttagtagagatgtggtttcaccgtgttagccaggatggtcttgatctcctgaccttgtgatccacccgcctcggcctcccaaagtgctggtattacaggagtgagccaccgcgcctggccagactccttattctttttaaggcctgcgttgttctttgcacaccgatgaacacaaaagtcagaagtttttgatattataaaacattgaagtagtgaacatttctatgtaaatatttttgaatgcatatctcatagccccggaggtaatttcactcaaaatagaatttcttaatcaaatagtatgtgtcgttatgctttttatggatgttgccacactgtactgagttatgtttgttcattcagaaaatatctcctgagcatctattatgtgtaagcagtgtgctgcgtgttagcaaagagactttagctgccctttgtgcgtcctaacagtctagggagggagtagatattaaagaatcacacaaatgcctatacaattacaattccaacaagtgctgagaaggggagtgacatggtacaatgagagcatagaatagggaggatttgacttcaacaagaggactagaggtttctgtggggaggtctgagcaaatatctgaagtataagtaggtgttaaccaggtagggatgttgtggagagaattctgaacgtaaggatcagcagagaccatattaacaggaaaatatatactgtgttggaggaactggctagggagactgggccatgggggtagtatggcgttaaaatggagctggaaatatgaataggagctgaaaccatgcagagctatgtttaaggttttagtcactaccttaagagcaatagaaaaccattgaattttttttgttggggatgagtgtggggaacacattcaaatttgtattttcaacctatcattttgctgctgagtggagaatacactgcagagggaaagaggtagaagcaaggagacaagttgggaggtgtttgtaggaactgaggcataatggtggattggaccagggcatggtggtcattttggtagaaagatacagatatactctatagagatatttaggtaatattgttgtcaggagttggtggtgaattgaatatgagagtttggaagaaatggctgacagtgatggtgactcccaagtttctggcccattctgttggttatacagtattttttagatataatgttaatatttttcccaatttgtcttttgttcattgttggtttctgataaatactctgtcatattaaggaagtctctatttttagtgtataaagcattttgataaaaaatgattctgcattttctttccttttgtttattaaattacattaatgtaaataaatatataaata

SEQ ID NO: 128181 - DNA, 1270 bp, Homo sapiens
  Payload ID: 5100
  Gene Symbol: DUSP12
  Gene Name: dual specificity phosphatase 12
  Uniprot ID: Q9UNI6
  ENST ID: ENST00000367943
  CDS Start-End: 33-1055
ggcaggaagccgccttgtctctgggcgcggccatgttggaggctccgggcccgagtgatggctgcgagctcagcaaccccagcgccagcagagtcagctgtgccgggcagatgctggaagtgcagccaggattgtatttcggtggggccgcggccgtcgcggagccagatcacctgagggaagcgggcatcacggccgtgctaacagtggactcggaggagcccagcttcaaggcggggcctggggtcgaggatctatggcgcctcttcgtgccagcgctggacaaacccgagacggacctactcagccatctggaccggtgcgtggccttcatcggtcaggcccgcgctgagggccgtgcggtgttggtgcactgtcatgcaggagtcagtcgaagtgtggccataataactgcttttctcatgaagactgaccaacttccctttgaaaaagcctatgaaaagctccagattctcaaaccagaggctaagatgaatgaggggtttgagtggcaactgaaattataccaggcaatgggatacgaagtggatacctctagtgcaatttataagcaatatcgtttacaaaaggttacagagaagtatccagaattgcagaatttacctcaagaactctttgctgttgacccaactaccgtttcacaaggattgaaagatgaggttctctacaagtgtagaaagtgcaggcgatcattatttcgaagttctagtattctggatcaccgtgaaggaagtggacctatagcctttgcccacaagagaatgacaccatcttccatgcttaccacagggaggcaagctcaatgtacatcttatttcattgaacctgtacagtggatggaatctgctttgttgggagtgatggatggacagcttctttgcccaaaatgcagtgccaagttgggttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagattgtttgtgctttcaacatttcatttgaaatgggagaagataaaatcacttgatgtaacctggaaactatgctttacatggcaatcaaagccttttgatcatgtacattttatttgatattaaaatcttttataaccaga

SEQ ID NO: 128182 - DNA, 1252 bp, Homo sapiens
  Payload ID: 5100
  Gene Symbol: DUSP12
  Gene Name: dual specificity phosphatase 12
  ENST ID: ENST00000484291
  CDS Start-End: 45-458
actcgatggtagggcaggaagccgccttgtctctgggcgcggccatgttggaggctccgggcccgagtgatggctgcgagctcagcaaccccagcgccagcagagtcagctgtgccgggcagatgctggaagtgcagccaggattgtatttcggtggggccgcggccgtcgcggagccagatcacctgagggaagcgggcatcacggccgtgctaacagtggactcggaggagcccagcttcaaggcggggcctggggtcgaggatctatggcgcctcttcgtgccagcgctggacaaacccgagacggacctactcagccatctggaccggtgcgtggccttcatcggtcaggcccgcgctgagggccgtgcggtgttggtgcactggtctctttttcagtcatgcaggagtcagtcgaagtgtggccataataactgcttttctcatgaagactgaccaacttccctttgaaaaagcctatgaaaagctccagattctcaaaccagaggctaaaattgcagaatttacctcaagaactctttgctgttgacccaactaccgtttcacaaggattgaaagatgaggttctctacaagtgtagaaagtgcaggcgatcattatttcgaagttctagtattctggatcaccgtgaaggaagtggacctatagcctttgcccacaagagaatgacaccatcttccatgcttaccacagggaggcaagctcaatgtacatcttatttcattgaacctgtacagtggatggaatctgctttgttgggagtgatggatggacagcttctttgcccaaaatgcagtgccaagttgggttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagattgtttgtgctttcaacatttcatttgaaatgggagaagataaaatcacttgatgtaacctggaaactatgctttacatggcaatcaaagccttttgatcatgtacattttatttgatattaaaatcttttataaccagatactgtctgtgtttcatatatttttaaaagttttgattgttggaatgttatatgatcttaaggtctgtatagacaa

SEQ ID NO: 128183 - DNA, 740 bp, Homo sapiens
  Payload ID: 5100
  Gene Symbol: DUSP12
  Gene Name: dual specificity phosphatase 12
  ENST ID: ENST00000464004
  CDS Start-End: 23-436
cgccttgtctctgggcgcggccatgttggaggctccgggcccgagtgatggctgcgagctcagcaaccccagcgccagcagagtcagctgtgccgggcagatgctggaagtgcagccaggattgtatttcggtggggccgcggccgtcgcggagccagatcacctgagggaagcgggcatcacggccgtgctaacagtggactcggaggagcccagcttcaaggcggggcctggggtcgaggatctatggcgcctcttcgtgccagcgctggacaaacccgagacggacctactcagccatctggaccggtgcgtggccttcatcggtcaggcccgcgctgagggccgtgcggtgttggtgcactggtctctttttcagtcatgcaggagtcagtcgaagtgtggccataataactgcttttctcatgaagactgaccaacttccctttgaaaaagcctatgaaaagctccagattctcaaaccagaggctaagatgaatgaggggtttgagtggcaactgaaattataccaggcaatgggatacgaagtggatacctctagtgcaatttataagcaatatcgtttacaaaaggttacagagaagtatccagaattgcagaatttacctcaagaactctttgctgttgacccaactaccgtttcacaaggattgaaagatgaggttctctacaagtgtagaaagtgcaggcgatcattatttcgaagttctagtattctg

SEQ ID NO: 128184 - DNA, 657 bp, Homo sapiens
  Payload ID: 5100
  Gene Symbol: DUSP12
  Gene Name: dual specificity phosphatase 12
  ENST ID: ENST00000490591
  CDS Start-End: 76-324
ttggaggctccgggcccgagtgatggctgcgagctcagcaaccccagcgccagcagagtcagctgtgccgggcagatgctggaagtgcagccaggattgtatttcggtggggccgcggccgtcgcggagccagatcacctgagggaagcgggcatcacggccgtgctaacagtggactcggaggagcccagcttcaaggcggggcctggggtcgaggatctatggcgcctcttcgtgccagcgctggacaaacccgagacggacctactcagccatctggaccgggtcttgctctgtcacccaggctacagtgtagtagcgtaattacggctcactgcagtctcaacctcccaggctcaagtgaacctcctgcctcggcctccagagtagctgggactacagaccccaccacatccggctaattttttgtagaggtggggtctcactttgttgcccaggctggtctccaactcttggactcaaccaatcctctcacctcgcctcccaaagtgctgggatttcaggcgtaggtctctttttcagtcatgcaggagtcagtcgaagtgtggccataataactgcttttctcatgaagactgaccaacttccctttgaaaaagcctatgaaaagctccagattctcaaaccagaggctaa

SEQ ID NO: 128185 - DNA, 1110 bp, Homo sapiens
  Payload ID: 5101
  Gene Symbol: DUSP13
  Gene Name: dual specificity phosphatase 13
  Uniprot ID: Q6B8I1
  ENST ID: ENST00000308475
  CDS Start-End: 29-211
agaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcaaacagcatcaagtgtgcggagacaggcggctgaaagccagcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaa

SEQ ID NO: 128186 - DNA, 781 bp, Homo sapiens
  Payload ID: 5101
  Gene Symbol: DUSP13
  Gene Name: dual specificity phosphatase 13
  Uniprot ID: Q9UII6
  ENST ID: ENST00000372700
  CDS Start-End: 35-781
gaccacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcgatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctga

SEQ ID NO: 128187 - DNA, 1778 bp, Homo sapiens
  Payload ID: 5101
  Gene Symbol: DUSP13
  Gene Name: dual specificity phosphatase 13
  Uniprot ID: Q6B8I1
  ENST ID: ENST00000372702
  CDS Start-End: 65-631
agaaatgacactggagaggcagagaggagtgaccacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcggccacggcaaacaaccgctttgagctgtggaagctgggcatcacccacgtgctgaacgccgcccacaagggcctctactgtcagggcggccctgacttctacggcagcagtgtgagctacctgggggtgccagcccacgacctccctgattttgacatcagtgcctacttctcctctgcggctgacttcatccaccgtgccctcaacacgcctggggccaaggtcctggtgcactgtgtggtgggcgtgagccgctctgccacgctggtcctggcctacctcatgctgcaccagcggctgtccctgcgccaggcggtgatcaccgtgaggcagcaccgatgggtcttccccaaccgaggcttcctgcaccagctctgcaggctggaccagcaactgcggggtgccggccagagctgaggggccagagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgcggagacaggcggctgaaagccagcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaaga

SEQ ID NO: 128188 - DNA, 684 bp, Homo sapiens
  Payload ID: 5101
  Gene Symbol: DUSP13
  Gene Name: dual specificity phosphatase 13
  ENST ID: ENST00000464872
  CDS Start-End: 1-444
atggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaa

SEQ ID NO: 128189 - DNA, 1770 bp, Homo sapiens
  Payload ID: 5101
  Gene Symbol: DUSP13
  Gene Name: dual specificity phosphatase 13
  Uniprot ID: Q9UII6
  ENST ID: ENST00000491677
  CDS Start-End: 931-1527
actggagaggcagagaggagtgaccacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcggccacggcaaacaaccgctttgagctgtggaagctgggcatcacccacgtgctgaacgccgcccacaagggcctctactgtcagggcggccctgacttctacggcagcagtgtgagctacctgggggtgccagcccacgacctccctgattttgacatcagtgcctacttctcctctgcggctgacttcatccaccgtgccctcaacacgcctggggccaaggtcctggtgcactgtgtggtgggcgtgagccgctctgccacgctggtcctggcctacctcatgctgcaccagcggctgtccctgcgccaggcggtgatcaccgtgaggcagcaccgatgggtcttccccaaccgaggcttcctgcaccagctctgcaggctggaccagcaactgcggggtgccggccagagctgaggggccagagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgcggagacaggcggctgaaagccagcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagac

SEQ ID NO: 128190 - DNA, 920 bp, Homo sapiens
  Payload ID: 5101
  Gene Symbol: DUSP13
  Gene Name: dual specificity phosphatase 13
  Uniprot ID: Q9UII6
  ENST ID: ENST00000472493
  CDS Start-End: 80-676
tgcccagccctgttccgctcaggcagagtcctgcccctgcacccactcccccattcccggccccaggccatgccccaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagaca

SEQ ID NO: 128191 - DNA, 1129 bp, Homo sapiens
  Payload ID: 5101
  Gene Symbol: DUSP13
  Gene Name: dual specificity phosphatase 13
  Uniprot ID: Q6B8I1
  ENST ID: ENST00000394707
  CDS Start-End: 34-237
accacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgcggagacaggcggctgaaagccagcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctg

SEQ ID NO: 128192 - DNA, 1556 bp, Homo sapiens
  Payload ID: 5101
  Gene Symbol: DUSP13
  Gene Name: dual specificity phosphatase 13
  Uniprot ID: Q6B8I1
  ENST ID: ENST00000479884
  CDS Start-End: 56-556
actggagaggcagagaggagtgaccacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcggccacggcaaacaaccgctttgagctgtggaagctgggcatcacccacgtgctgaacgccgcccacaagggcctctactgtcagggcggccctgacttctacggcagcagtgtgagctacctgggggtgccagcccacgacctccctgattttgacatcagtgcctacttctcctctgcggctgacttcatccaccgtgccctcaacacgcctggggagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgcggagacaggcggctgaaagccagcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcat

SEQ ID NO: 128193 - DNA, 1411 bp, Homo sapiens
  Payload ID: 5101
  Gene Symbol: DUSP13
  Gene Name: dual specificity phosphatase 13
  Uniprot ID: Q6B8I1
  ENST ID: ENST00000494588
  CDS Start-End: 62-340
aatgacactggagaggcagagaggagtgaccacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgccagggggccaggcacagcctccctcctggtcccatggcttggccggcatcaagtgcccttcctgccctccccagggccacggcaaacaaccgctttgagctgtggaagctgggcatcacccacgtgctgaacgccgcccacaagggcctctactgtcagggcggccctgacttctacggcagcagtgtgagctacctgggggtgccagcccacgacctccctgattttgacatcagtgcctacttctcctctgcggctgacttcatccaccgtgccctcaacacgcctggggagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgcggagacaggcggctgaaagccagcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcag

SEQ ID NO: 128194 - DNA, 1335 bp, Homo sapiens
  Payload ID: 5101
  Gene Symbol: DUSP13
  Gene Name: dual specificity phosphatase 13
  ENST ID: ENST00000478873
  CDS Start-End: 91-1095
gtttgtgttctgggcagaacctgcccagccctgttccgctcaggcagagtcctgcccctgcacccactcccccattcccggccccaggccatgccccaggtaggtggcaggccactcagccacctggagaggtcacagtgggggatgaggaggacagcttggtcttcacttccgccttgcccgacagcctcccactgggtgagcctggccaagccggcagcctcctgggtgcctgtttctttttctggtcctggcactgcctaccaaagggaaaagatgttcttcccagtatgcaccttccctagtcactggtccaggggatcaggggcagttagcaaagacaggaccccctctccaacacggcaccaggcccatattctggtgccgctgaaaatccagctccgcagggtccctgactccttcagccagcagatgcctgaaacaagctacctgacccgggtggggcctgacatccagtgctggcctgagtcgtgggggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaa

SEQ ID NO: 128195 - DNA, 1015 bp, Homo sapiens
  Payload ID: 5101
  Gene Symbol: DUSP13
  Gene Name: dual specificity phosphatase 13
  ENST ID: ENST00000605915
  CDS Start-End: 113-775
ggcagaacctgcccagccctgttccgctcaggcagagtcctgcccctgcacccactcccccattcccggccccaggccatgccccagggtccctgactccttcagccagcagatgcctgaaacaagctacctgacccgggtggggcctgacatccagtgctggcctgagtcgtgggggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaa

SEQ ID NO: 128196 - DNA, 628 bp, Homo sapiens
  Payload ID: 5101
  Gene Symbol: DUSP13
  Gene Name: dual specificity phosphatase 13
  ENST ID: ENST00000473072
  CDS Start-End: 50-628
gaggcagagaggagtgaccacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcccaaggtcctggtgcactgtgtggtgggcgtgagccgctctgccacgctggtcctggcctacctcatgctgcaccagcggctgtccctgcgccaggcggtgatcaccgtgaggcagcaccgatgggtcttccccaaccgaggcttcctgcaccagctctgcaggctggaccagcaactgcggggtgccggccagagctgaggggccagagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgc

SEQ ID NO: 128197 - DNA, 1019 bp, Homo sapiens
  Payload ID: 5101
  Gene Symbol: DUSP13
  Gene Name: dual specificity phosphatase 13
  Uniprot ID: Q9UII6
  ENST ID: ENST00000607131
  CDS Start-End: 188-784
gcatcctggagctggaggagctcctgcgggcagggaagtcttcttgcagccgtgtggacgaagtttggcccaaccttttcataggagatgcaaacagcatcaagtgtgcggagacaggcggctgaaagccagcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtc

SEQ ID NO: 128198 - DNA, 780 bp, Homo sapiens
  Payload ID: 5101
  Gene Symbol: DUSP13
  Gene Name: dual specificity phosphatase 13
  ENST ID: ENST00000607487
  CDS Start-End: 1-780
ctggggggagaggacaaagccacgccttgccccagcatcctggagctggaggagctcctgcgggcagggaagtcttcttgcagccgtgtggacgaagtttggcccaaccttttcataggagatgcccaaggtcctggtgcactgtgtggtgggcgtgagccgctctgccacgctggtcctggcctacctcatgctgcaccagcggctgtccctgcgccaggcggtgatcaccgtgaggcagcaccgatgggtcttccccaaccgaggcttcctgcaccagctctgcaggctggaccagcaactgcggggtgccggccagagctgaggggccagagctggtccttactccctgccatggggctctgccactttgccaccctggcactgatcctgctggtgctgctggaggctctggcccaggcggacacacagaagatgaaacagcatcaagtgtgcggagacaggcggctgaaagccagcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaag

SEQ ID NO: 128199 - DNA, 2207 bp, Homo sapiens
  Payload ID: 5102
  Gene Symbol: DUSP14
  Gene Name: dual specificity phosphatase 14
  Uniprot ID: O95147
  ENST ID: ENST00000614411
  CDS Start-End: 979-1575
atatgtcaagaacacctcaacagagctgtaaaaaaaacacgacaggtctgacagttacctgggaaaggtgggggaacaggtggtagaagaacacattttttatgatgttcatggtacttacataacataaatgaataaaatagggccaacatggaaaagaaaacaaaatgaaggaaaatgtcaaattgccatcctgaacaccagcaccgcctgtaattagcgttcctggctgcagccacatctgcggtcctgctcctcatgaagccgtcctccgtgccatgtcccggccatgcctgtccttagcttcctggtgcacactgtcctccaccttgtgttcaggcacagggctgcttggctcacccttgctgcacctggcctgtccgtcctcccaccgcggtgccgcccaggccttcccactgcagggctggctaacggtgcatggaagagactcgagtccgtgttgtgtcctcatagcccaccgaggaggcagcagtgccggacatttcgcggataggttgtggtctctgagtctcctcctctcaagaggatgagatttgtctgtgttattgtcaaaactcttatttgtcacgccgcgggttatgtgtcagtaacaaaaagctgagatttaggccggtgtttcttactggtgcagcctttaaatgcacacctgcgaatgttcagtgcaccttccgcttcctggctctatttcagtcaaacctgaggtcgtagtgaaagtcggtgaggaattctttggaacttcctgattggctgtgtccttgcctccttgtcttcccgcagatttgatttgtatccactgtcaccagcactgctcacttaggactttctggatccggacccaggcagcgcacactggactcttgaggaagaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatcacctgcattgttaatgctaccattgagatccctaatttcaactggccccaatttgagtatgttaaagtgcctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcgtacaactgggtgaaagcccggcgacctgtcatcaggcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcagcagcccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataaccagcttcagtctctactggattagccctactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctatatgcttaacatatta

SEQ ID NO: 128200 - DNA, 1537 bp, Homo sapiens
  Payload ID: 5102
  Gene Symbol: DUSP14
  Gene Name: dual specificity phosphatase 14
  Uniprot ID: O95147
  ENST ID: ENST00000614294
  CDS Start-End: 309-905
cgcggcccgccccgggcgcgggcggagggaggaggaggcggcgcgcgcggcgcccagcccgcagaagccggtggccgcgcaggaggacggagccctaaccgcaacccgcgccgcgccgcgccgcgccgatttgatttgtatccactgtcaccagcactgctcacttaggactttctggatccggacccaggcagcgcacactggactcttgaggaagaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatcacctgcattgttaatgctaccattgagatccctaatttcaactggccccaatttgagtatgttaaagtgcctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcgtacaactgggtgaaagcccggcgacctgtcatcaggcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcagcagcccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataaccagcttcagtctctactggattagccctactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctatatgcttaacatatta

SEQ ID NO: 128201 - DNA, 1537 bp, Homo sapiens
  Payload ID: 5102
  Gene Symbol: DUSP14
  Gene Name: dual specificity phosphatase 14
  Uniprot ID: O95147
  ENST ID: ENST00000617516
  CDS Start-End: 309-905
cgcggcccgccccgggcgcgggcggagggaggaggaggcggcgcgcgcggcgcccagcccgcagaagccggtggccgcgcaggaggacggagccctaaccgcaacccgctccgcgccgcgccgcgccgatttgatttgtatccactgtcaccagcactgctcacttaggactttctggatccggacccaggcagcgcacactggactcttgaggaagaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatcacctgcattgttaatgctaccattgagatccctaatttcaactggccccaatttgagtatgttaaagtgcctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcgtacaactgggtgaaagcccggcgacctgtcatcaggcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcagcagcccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataaccagcttcagtctctactggattagccctactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctatatgcttaacatatta

SEQ ID NO: 128202 - DNA, 1559 bp, Homo sapiens
  Payload ID: 5102
  Gene Symbol: DUSP14
  Gene Name: dual specificity phosphatase 14
  Uniprot ID: O95147
  ENST ID: ENST00000613659
  CDS Start-End: 345-941
ctcatcttctgacgcttgggggaggagaggtagttgcttggtatttttggctttccaccataaaactggagacagtttccttcattccaagtcgttttaatgtcactgttgaacgtgtgtgtcctgagttctcatctgaaagctttcatatcggttgactgcagatttgatttgtatccactgtcaccagcactgctcacttaggactttctggatccggacccaggcagcgcacactggactcttgaggaagaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatcacctgcattgttaatgctaccattgagatccctaatttcaactggccccaatttgagtatgttaaagtgcctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcgtacaactgggtgaaagcccggcgacctgtcatcaggcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcagcagcccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataaccagcttcagtctctactggattagccctactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctata

SEQ ID NO: 128203 - DNA, 1559 bp, Homo sapiens; identical to SEQ ID NO: 128202
  Payload ID: 5102
  Gene Symbol: DUSP14
  Gene Name: dual specificity phosphatase 14
  ENST ID: ENST00000632468
  CDS Start-End: 345-941

SEQ ID NO: 128204 - DNA, 2207 bp, Homo sapiens; identical to SEQ ID NO: 128199
  Payload ID: 5102
  Gene Symbol: DUSP14
  Gene Name: dual specificity phosphatase 14
  ENST ID: ENST00000633870
  CDS Start-End: 979-1575

SEQ ID NO: 128205 - DNA, 1732 bp, Homo sapiens
  Payload ID: 5103
  Gene Symbol: DUSP15
  Gene Name: dual specificity phosphatase 15
  Uniprot ID: Q9H1R2
  ENST ID: ENST00000278979
  CDS Start-End: 78-965
gttgtcccgcgggccgtgggcccggcacactggggctttgtccggccccccgccgcgacccgaggcgggggccccacatgaccgaaggggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagggtgccagacataggacctcaaaaacctctggtgcccaatgccctccgatgacttcagcaacctgcctgctggctgcacgtgtggctcttctctccgcagcgctggtgcgcgaagccaccgggcgcacagcccagcgctgtcgtctgagtccgcgggcggccgccgagcgcctgctggggccgccacctcacgttgcagcaggatggtcaccggacccaaagtaccagatctgtctgtgcttcggtgaggaggacccgggccccacacagcaccccaaggagcagctcatcatggcggacgtgcaggtgcagcttcggcctgggagctcgtcctgcactctaagtgcctcaaccgagcgcccagatgggtcctcaacccctggcaaccccgatggcatcactcaccttcaatgcagctgcctccatcctaagcgagccgcttcctcttcttgtacccgctgaaggcagcccccaacaggggggctccctactcccacccaaccctgcccacactaagcccatagacttggggcctcccccggcacatcacccaggtctgccggacggcagaggtggatcgcggccttccactcctctgtcacggggccccggaactcgagagtaggccacaccgccccccagctgggcatggggcttcggcaggaaactgaacttgatcttgaggccccagaaaggcagcaactggagcagaagcaagacttcatctcttgctgacagcccaatttgtcaatagcgctttcctcagagccagccttaacctgctgttgagtccattaaaacgtttgcttaaagtttttaccaataattagatcatcagggttgtttagtgtgggatcaagccataacaaaactgcctagcctctcaggggcctagaatttacagaaccttcctcctccctgcagctagtctctcttctttattctgggggctgggaaggatcccaaaacagggaacttggccgaaccctgggctttggatgctaaccactgaagtaccagcacctgtaggatgctgtctttgaagaaactgaggcggacctccaaatgcagccctaaggcagaggtcaacgtggaagaccagcccttctccaagccccactggtctttgcaagctgtacgttgtaggcaatctgagaactggaaagggggactacaaccagaaagttggttaccctgccatgggaataaagtagctgttttccacccca

SEQ ID NO: 128206 - DNA, 1454 bp, Homo sapiens
  Payload ID: 5103
  Gene Symbol: DUSP15
  Gene Name: dual specificity phosphatase 15
  Uniprot ID: Q9H1R2
  ENST ID: ENST00000339738
  CDS Start-End: 411-1118
cgcgcctgccggtgccagggtggggtaaggcccccgcccccacctccggaggtggcggccccacgcggccccaacaaactgccgttgtcccgcgggccgtgggcccggcacactggggctttgtccggccccccgccgcgacccgaggcgggggccccacatgaccgaaggggtaggaggagcctgcggcggcggcggtggcagcggcggctccaccaccatttccctcccgggccgggggtcggcgggcggtggcggtggctgggcagggctgggcagggccgcggacgccaggccccccgttccccgccaggctgcaggcgtcgggcctgggccgtcagggcagctgtgaccggatcgcttcccgggcggcgagctgggggtgcacccggaccgccgcccccgggatcatgggcaatggcatgaccaaggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtc

SEQ ID NO: 128207 - DNA, 1077 bp, Homo sapiens
  Payload ID: 5103
  Gene Symbol: DUSP15
  Gene Name: dual specificity phosphatase 15
  Uniprot ID: Q9H1R2
  ENST ID: ENST00000375966
  CDS Start-End: 43-741
ctttgtccggccccccgccgcgacccgaggcgggggccccacatgaccgaaggggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtc

SEQ ID NO: 128208 - DNA, 1212 bp, Homo sapiens
  Payload ID: 5103
  Gene Symbol: DUSP15
  Gene Name: dual specificity phosphatase 15
  Uniprot ID: Q9H1R2
  ENST ID: ENST00000398083
  CDS Start-End: 478-876
cctcggctctctccggggctgtttctccatcctgtcccgcctctgcctgtcattgcctttctgcctccccagccccagaatttccatccctgcaccctgcaagtctacctctctcctctcctctcctcctaagacctgccttcctcctctcccctctcatacccaagctggcctcccttggttccctcggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtc

SEQ ID NO: 128209 - DNA, 1256 bp, Homo sapiens
  Payload ID: 5103
  Gene Symbol: DUSP15
  Gene Name: dual specificity phosphatase 15
  Uniprot ID: Q9H1R2
  ENST ID: ENST00000398084
  CDS Start-End: 522-920
gccccggccgccgcggcccggcgctgaccagctcggtccgcccgcctctgaccttctgttctcgccggtctccgtgcggcggcatctccgtgtccctgtgactcgagaccgcggctgtcgggtctccccctctctgaccctgcgtctctgtccccgctgtgtccgccctctctccgtgactctgtgtgtctctcgctgtcttgctgtggctgtcactcccaggctgtctcccagtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtc

SEQ ID NO: 128210 - DNA, 464 bp, Homo sapiens
  Payload ID: 5103
  Gene Symbol: DUSP15
  Gene Name: dual specificity phosphatase 15
  ENST ID: ENST00000428829
  CDS Start-End: 236-464
ggaggagcctgcggcggcggcggtggcagcggcggctccaccaccatttccctcccgggccgggggtcggcgggcggtggcggtggctgggcagggctgggcagggccgcggacgccaggccccccgttccccgccaggctgcaggcgtcgggcctgggccgtcagggcagctgtgaccggatcgcttcccgggcggcgagctgggggtgcacccggaccgccgcccccgggatcatgggcaatggcatgaccaagatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactg

SEQ ID NO: 128211 - DNA, 1048 bp, Homo sapiens
  Payload ID: 5103
  Gene Symbol: DUSP15
  Gene Name: dual specificity phosphatase 15
  ENST ID: ENST00000447647
  CDS Start-End: 1-281
acacgcggcttcctccaggcggatggtcaccggacccaaagtaccagatctgtctgtgcttcggtgaggaggacccgggccccacacagcaccccaaggagcagctcatcatggcggacgtgcaggtgcagcttcggcctgggagctcgtcctgcactctaagtgcctcaaccgagcgcccagatgggtcctcaacccctggcaaccccgatggcatcactcaccttcaatgcagctgcctccatcctaagcgagccgcttcctcttcttgtacccgctgaaggcagcccccaacaggggggctccctactcccacccaaccctgcccacactaagcccatagacttggggcctcccccggcacatcacccaggtctgccggacggcagaggtggatcgcggccttccactcctctgtcacggggccccggaactcgagagtaggccacaccgccccccagctgggcatggggcttcggcaggaaactgaacttgatcttgaggccccagaaaggcagcaactggagcagaagcaagacttcatctcttgctgacagcccaatttgtcaatagcgctttcctcagagccagccttaacctgctgttgagtccattaaaacgtttgcttaaagtttttaccaataattagatcatcagggttgtttagtgtgggatcaagccataacaaaactgcctagcctctcaggggcctagaatttacagaaccttcctcctccctgcagctagtctctcttctttattctgggggctgggaaggatcccaaaacagggaacttggccgaaccctgggctttggatgctaaccactgaagtaccagcacctgtaggatgctgtctttgaagaaactgaggcggacctccaaatgcagccctaaggcagaggtcaacgtggaagaccagcccttctccaagccccactggtctttgcaagctgtacgttgtaggcaatctgagaactggaaagggggactacaaccagaaagttggttaccctgccatgggaataaagtagctgttttccacccca

SEQ ID NO: 128212 - DNA, 1651 bp, Homo sapiens
  Payload ID: 5103
  Gene Symbol: DUSP15
  Gene Name: dual specificity phosphatase 15
  Uniprot ID: Q9H1R2
  ENST ID: ENST00000486996
  CDS Start-End: 917-1315
ctgttctcgccggtctccgtgcggcggcatctccgtgtccctgtgactcgagaccgcggctgtcgggtctccccctctctgaccctgcgtctctgtccccgctgtgtccgccctctctccgtgactctgtgtgtctctcgctgtcttgctgtggctgtcactcccaggctgtctcccagtgagtcctgctctccgtctgcatgtgtccctctcccttgtcgctgactcctcggctctctccggggctgtttctccatcctgtcccgcctctgcctgtcattgcctttctgcctccccagccccagaatttccatccctgcaccctgcaagtctacctctctcctctcctctcctcctaagacctgccttcctcctctcccctctcatacccaagctggcctcccttggttccctcggttggttaactggccccctagcctaccctccccagagccccagacccctctcacagaggactcagggcccacaaaagggaagagagtgctccctgagccctgaggtccatacccttcatgggacagagaggggctgtgggccccccagctgccctgggggtggaagggggtgcagcccctgccccactgacccttgcctgtccttcctctaggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtc

SEQ ID NO: 128213 - DNA, 3402 bp, Homo sapiens
  Payload ID: 5104
  Gene Symbol: DUSP16
  Gene Name: dual specificity phosphatase 16
  Uniprot ID: Q9BY84
  ENST ID: ENST00000228862
  CDS Start-End: 633-1064
ggaagagaaagagtgaagaaaagttgcgagcgtctcctctcttcctaagcctcccgccccaacccacccctcagagaaggagaagataatatactgaaaagaagaggaggaggagagcgacgggacgggacgcgagcgggagcgcagccgccctctcggctccgcggcggcgcctcgcaagtccgggaggcgaggggggcccgaggggagacgccgtgacaactttcgtttccctctgagggaattgggaggtcggcggccccaaaagctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgattggaactcaaattgttactgagaggttggtggctctgctggaaagtggaacggaaaaagtgctgctaattgatagccggccatttgtggaatacaatacatcccacattttggaagccattaatatcaactgctccaagcttatgaagcgaaggttgcaacaggacaaagtgttaattacagagctcatccagcattcagcgaaacataaggttgacattgattgcagtcagaaggttgtagtttacgatcaaagctcccaagatgttgcctctctctcttcagactgttttctcactgtacttctgggtaaactggagaagagcttcaactctgttcacctgcttgcaggagctgatgcagcagaatgggattggttatgtgttaaatgccagcaatacctgtccaaagcctgactttatccccgagtctcatttcctgcgtgtgcctgtgaatgacagcttttgtgagaaaattttgccgtggttggacaaatcagtagatttcattgagaaagcaaaagcctccaatggatgtgttctagtgcactgtttagctgggatctcccgctccgccaccatcgctatcgcctacatcatgaagaggatggacatgtctttagatgaagcttacagatttgtgaaagaaaaaagacctactatatctccaaacttcaattttctgggccaactcctggactatgagaagaagattaagaaccagactggagcatcagggccaaagagcaaactcaagctgctgcacctggagaagccaaatgaacctgtccctgctgtctcagagggtggacagaaaagcgagacgcccctcagtccaccctgtgccgactctgctacctcagaggcagcaggacaaaggcccgtgcatcccgccagcgtgcccagcgtgcccagcgtgcagccgtcgctgttagaggacagcccgctggtacaggcgctcagtgggctgcacctgtccgcagacaggctggaagacagcaataagctcaagcgttccttctctctggatatcaaatcagtttcatattcagccagcatggcagcatccttacatggcttctcctcatcagaagatgctttggaatactacaaaccttccactactctggatgggaccaacaagctatgccagttctcccctgttcaggaactatcggagcagactcccgaaaccagtcctgataaggaggaagccagcatccccaagaagctgcagaccgccaggccttcagacagccagagcaagcgattgcattcggtcagaaccagcagcagtggcaccgcccagaggtcccttttatctccactgcatcgaagtgggagcgtggaggacaattaccacaccagcttccttttcggcctttccaccagccagcagcacctcacgaagtctgctggcctgggccttaagggctggcactcggatatcttggccccccagacctctaccccttccctgaccagcagctggtattttgccacagagtcctcacacttctactctgcctcagccatctacggaggcagtgccagttactctgcctacagctgcagccagctgcccacttgcggagaccaagtctattctgtgcgcaggcggcagaagccaagtgacagagctgactcgcggcggagctggcatgaagagagcccctttgaaaagcagtttaaacgcagaagctgccaaatggaatttggagagagcatcatgtcagagaacaggtcacgggaagagctggggaaagtgggcagtcagtctagcttttcgggcagcatggaaatcattgaggtctcctgagaagaaagacacttgtgacttctatagacaatttttttttcttgttcacaaaaaaattccctgtaaatctgaaatatatatatgtacatacatatatatttttggaaaatggagctatggtgtaaaagcaacaggtggatcaacccagttgttactctcttaacatctgcatttgagagatcagctaatacttctctcaacaaaaatggaagggcagatgctagaatcccccctagacggaggaaaaccattttattcagtgaattacacatcctcttgttcttaaaaaagcaagtgtctttggtgttggaggacaaaatcccctaccattttcacgttgtgctactaagagatctcaaatattagtctttgtccggacccttccatagtacaccttagcgctgagactgagccagcttgggggtcaggtaggtagaccctgttagggacagagcctagtggtaaatccaagagaaatgatcctatccaaagctgattcacaaacccacgctcacctgacagccgagggacacgagcatcactctgctggacggaccattaggggccttgccaaggtctaccttagagcaaacccagtacctcagacaggaaagtcggggctttgaccactaccatatctggtagcccattttctaggcattgtgaataggtaggtagctagtcacacttttcagaccaattcaaactgtctatgcacaaaattcccgtgggcctagatggagataatttttttttcttctcagctttatgaagagaagggaaactgtctaggattcagctgaaccaccaggaacctggcaacatcacgatttaagctaaggttgggaggctaacgagtctacctccctctttgtaaatcaaagaattgtttaaaatgggattgtcaatcctttaaataaagatgaacttggtttc

SEQ ID NO: 128214 - DNA, 5253 bp, Homo sapiens
  Payload ID: 5104
  Gene Symbol: DUSP16
  Gene Name: dual specificity phosphatase 16
  Uniprot ID: Q9BY84
  ENST ID: ENST00000298573
  CDS Start-End: 633-2630
ggaagagaaagagtgaagaaaagttgcgagcgtctcctctcttcctaagcctcccgccccaacccacccctcagagaaggagaagataatatactgaaaagaagaggaggaggagagcgacgggacgggacgcgagcgggagcgcagccgccctctcggctccgcggcggcgcctcgcaagtccgggaggcgaggggggcccgaggggagacgccgtgacaactttcgtttccctctgagggaattgggaggtcggcggccccaaaagctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgattggaactcaaattgttactgagaggttggtggctctgctggaaagtggaacggaaaaagtgctgctaattgatagccggccatttgtggaatacaatacatcccacattttggaagccattaatatcaactgctccaagcttatgaagcgaaggttgcaacaggacaaagtgttaattacagagctcatccagcattcagcgaaacataaggttgacattgattgcagtcagaaggttgtagtttacgatcaaagctcccaagatgttgcctctctctcttcagactgttttctcactgtacttctgggtaaactggagaagagcttcaactctgttcacctgcttgcaggtgggtttgctgagttctctcgttgtttccctggcctctgtgaaggaaaatccactctagtccctacctgcatttctcagccttgcttacctgttgccaacattgggccaacccgaattcttcccaatctttatcttggctgccagcgagatgtcctcaacaaggagctgatgcagcagaatgggattggttatgtgttaaatgccagcaatacctgtccaaagcctgactttatccccgagtctcatttcctgcgtgtgcctgtgaatgacagcttttgtgagaaaattttgccgtggttggacaaatcagtagatttcattgagaaagcaaaagcctccaatggatgtgttctagtgcactgtttagctgggatctcccgctccgccaccatcgctatcgcctacatcatgaagaggatggacatgtctttagatgaagcttacagatttgtgaaagaaaaaagacctactatatctccaaacttcaattttctgggccaactcctggactatgagaagaagattaagaaccagactggagcatcagggccaaagagcaaactcaagctgctgcacctggagaagccaaatgaacctgtccctgctgtctcagagggtggacagaaaagcgagacgcccctcagtccaccctgtgccgactctgctacctcagaggcagcaggacaaaggcccgtgcatcccgccagcgtgcccagcgtgcccagcgtgcagccgtcgctgttagaggacagcccgctggtacaggcgctcagtgggctgcacctgtccgcagacaggctggaagacagcaataagctcaagcgttccttctctctggatatcaaatcagtttcatattcagccagcatggcagcatccttacatggcttctcctcatcagaagatgctttggaatactacaaaccttccactactctggatgggaccaacaagctatgccagttctcccctgttcaggaactatcggagcagactcccgaaaccagtcctgataaggaggaagccagcatccccaagaagctgcagaccgccaggccttcagacagccagagcaagcgattgcattcggtcagaaccagcagcagtggcaccgcccagaggtcccttttatctccactgcatcgaagtgggagcgtggaggacaattaccacaccagcttccttttcggcctttccaccagccagcagcacctcacgaagtctgctggcctgggccttaagggctggcactcggatatcttggccccccagacctctaccccttccctgaccagcagctggtattttgccacagagtcctcacacttctactctgcctcagccatctacggaggcagtgccagttactctgcctacagctgcagccagctgcccacttgcggagaccaagtctattctgtgcgcaggcggcagaagccaagtgacagagctgactcgcggcggagctggcatgaagagagcccctttgaaaagcagtttaaacgcagaagctgccaaatggaatttggagagagcatcatgtcagagaacaggtcacgggaagagctggggaaagtgggcagtcagtctagcttttcgggcagcatggaaatcattgaggtctcctgagaagaaagacacttgtgacttctatagacaatttttttttcttgttcacaaaaaaattccctgtaaatctgaaatatatatatgtacatacatatatatttttggaaaatggagctatggtgtaaaagcaacaggtggatcaacccagttgttactctcttaacatctgcatttgagagatcagctaatacttctctcaacaaaaatggaagggcagatgctagaatcccccctagacggaggaaaaccattttattcagtgaattacacatcctcttgttcttaaaaaagcaagtgtctttggtgttggaggacaaaatcccctaccattttcacgttgtgctactaagagatctcaaatattagtctttgtccggacccttccatagtacaccttagcgctgagactgagccagcttgggggtcaggtaggtagaccctgttagggacagagcctagtggtaaatccaagagaaatgatcctatccaaagctgattcacaaacccacgctcacctgacagccgagggacacgagcatcactctgctggacggaccattaggggccttgccaaggtctaccttagagcaaacccagtacctcagacaggaaagtcggggctttgaccactaccatatctggtagcccattttctaggcattgtgaataggtaggtagctagtcacacttttcagaccaattcaaactgtctatgcacaaaattcccgtgggcctagatggagataatttttttttcttctcagctttatgaagagaagggaaactgtctaggattcagctgaaccaccaggaacctggcaacatcacgatttaagctaaggttgggaggctaacgagtctacctccctctttgtaaatcaaagaattgtttaaaatgggattgtcaatcctttaaataaagatgaacttggtttcaagccaaatgtgaatttatttgggttggtagcagagcagcagcaccttcaaattctcagccaaagcagatgtttttgccctttctgcttcactgcatggatacagttggtaaaatgtaataatatggcagaattttataggaaacttcctagggaggtaaattatgggaagattaagaaaggtacaaattgctgaggagaagcaggaaacctgtttccttagtggcttttatcccctcggcatgcgatggggctgatgtttctatgattgcctcagactttcacatttactagtagggctgagagaggctttagtgaggaaggaatattcagaataaaacggttgagaaagctgagaagaccattgagttttgatcagttgtgaatagagtgcaaagccatggccaagctgtttttggaaacgctggccggcgtgtcttcagtggaaaaagcaaatcaaaatggagcgagagcaaaggggcgtcctcagtcctcaacctacaatcactgtatggaatcggtcctggcagctgaacataggaggtcactggaacaagtgatagtgcagattggctttcaaacatcctcctggcttgagttttatcagctacaatgtgggtcctcttttgaagccttaattcacaacagcagctttttgggggtggggctgggcgggtgttgtcattgttctttcccttcctgtaagtgtcgctagttgctgcctcgtatctcaggtttttctctgtttttgagaaatggacagttttttgaccaggatgtgacttcatgtttcctatggtgacttctaaaaccagcacagaatgatatgactcaacacagaccgacttggttatggggatgatgagccgcacagacctcactagttgtgcacaaataatgtgctatgatggggtgtaaagtgaaggcagaagagggtcagccgcattgttatgatactgggaaagtgctggtcaacgatttgagttagtttttagatatacattgaaatctttaatcagacattctcaagtttcacacagtagtttttgatgttatgtacacacacaccaaatgtgtaacagttcaccacttccagagtgtggtcatgcccaaaacatgtttaagaaaggaaagcagtagctccttgctaacgatgtttcaggaggtttgggggacttggttttaatgagcttctgtcatttagggcttctcttggccatggtcccccttccttctggaactgtgatgtagtcacatcctacagcctttagtgctggttcactagtgtcagataatcagttcttggaatcgagactgccgtggcgaaggggtggcctcggaggcaggctctggagctgcttggatgtctttaggtggggtggtggctggctctcttcagcatgtaattggggaaaccctcgcgtctactaggggtgatacagatggtgattttaaagagcaaaactagacttctatgtgagaagtgctggaaaatgatttaggacatgtgtaaagttagatggaaagactgtaaatgtttaatatgaatatagtgttcttttgaagtaaggccagctgttgaacggttaaactgtgcatttctcattttgatgtgtcatgtatgttaatgtatgaaatgattaaataaaatcaaaactggtacctgtttatacataaatacgagaaaa

SEQ ID NO: 128215 - DNA, 585 bp, Homo sapiens
  Payload ID: 5104
  Gene Symbol: DUSP16
  Gene Name: dual specificity phosphatase 16
  ENST ID: ENST00000541207
  CDS Start-End: 568-585
gttttaaaagattataagtaaatactctgctctttcaagtgaaccaaacctatcaaacctgtttagaaaataaaccaggcagaataaaatgatgcgaaatgttcattttaaaaaacttcaggatgggcacaaacacacagaagtgggaaatgaataaaagagtattgataaatttttgaaaattgttgaagctgagtaatgggctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgatt

SEQ ID NO: 128216 - DNA, 566 bp, Homo sapiens
  Payload ID: 5104
  Gene Symbol: DUSP16
  Gene Name: dual specificity phosphatase 16
  ENST ID: ENST00000539940
  CDS Start-End: 492-566
aaaactctctgaagtttttatttacccagcgctctggctcccacttctgttttaaaagattataagtaaatactctgctctttcaagtgaaccaaacctatcaaacctgtttagaaaataaaccaggctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgattggaactcaaattgttactgagaggttggtggctctgctggaaagtggaacggaaaaa

SEQ ID NO: 128217 - DNA, 566 bp, Homo sapiens; identical to SEQ ID NO: 128216
  Payload ID: 5104
  Gene Symbol: DUSP16
  Gene Name: Dual specificity phosphatase 16
  ENST ID: ENST00000626461
  CDS Start-End: 492-566

SEQ ID NO: 128218 - DNA, 3402 bp, Homo sapiens; identical to SEQ ID NO: 128213
  Payload ID: 5104
  Gene Symbol: DUSP16
  Gene Name: Dual specificity phosphatase 16
  ENST ID: ENST00000628303
  CDS Start-End: 633-1064

SEQ ID NO: 128219 - DNA, 585 bp, Homo sapiens; identical to SEQ ID NO: 128215
  Payload ID: 5104
  Gene Symbol: DUSP16
  Gene Name: Dual specificity phosphatase 16
  ENST ID: ENST00000629698
  CDS Start-End: 568-585

SEQ ID NO: 128220 - DNA, 5253 bp, Homo sapiens; identical to SEQ ID NO: 128214
  Payload ID: 5104
  Gene Symbol: DUSP16
  Gene Name: Dual specificity phosphatase 16
  ENST ID: ENST00000626413
  CDS Start-End: 633-2630

SEQ ID NO: 128221 - DNA, 2479 bp, Homo sapiens
  Payload ID: 5105
  Gene Symbol: DUSP18
  Gene Name: dual specificity phosphatase 18
  Uniprot ID: Q8NEJ0
  ENST ID: ENST00000334679
  CDS Start-End: 507-1073
gtcgcacatgcgcacagagcccgggcggctacggaagcggtgagactgtctctcggctgcagccctggtgcgacccggcccgttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagagttttccatggacacagcctagcagaaagacgcagccttcgtgcttcgctgactgctgaccactgacccaccgccttgatgacagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggaggtagtgaacaccttgtatgaggatatccagtacatgcaggtacctgtggctgactcccctaactcacgtctctgtgacttctttgaccctattgctgaccatatccacagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacactgtgcacatggtcagttccccagtgggaatgatccctgacatctatgagaaggaagtccgtttgatgattccactgtgagccatcccacgagcccctgcattggagtcagaggtacagatctattgttgatcttacaccaagatccaaacttgaacattctacttttgttgatacagaaaaaaacagatgatgccttttatgagcacaaaaaagagttgctgtagcttttaactttataatccattttttttaagattaaactaattgtgagatggtgaagataaattttctgccctgtgagtgacactggccaggggataggttgaggcagatggtgcccagaagaaagagggcagcacccattgcacatggcaggcctggaatcctgcagccctccccaaaaacagattgacccaggaatgaatctgctacaattccacctcattctttcacacccagagccagagccttaagcatcatggtacctcttgcgcttcttacagtgagtgccaatctactagataaatggccttcaggcagtgctccaggaatcctggggggtcccaggccacctctgcttccaccttcactataagtggcccagttctggttttctagattgtacttatgcataagatagtttttaaagaaagcattccactgtgtaaatttttttttgtctttttttgaaactgtcctgctctgtcacccatcctagagtgcagtagtgtgatcatggctcactgtagccacaacctctcaggctcaagtgatcctcttaccttagcctcctgcgtggctgggactacagatgtttgccaccatgcccgcctcattttttttctttttttatagagatgagattttactatgtcgcccagactggtctcaaactcctggcctcaagcaatcctcacgcctcagcctcccaaagtgttgatgagccactgtaccccgataccactgtataaaaaatttaaaaaaaattgtgagtgctattgtacatggcaaagtttcaaagagctcttggccatccctcaccaaactttggcaaaagatggtgttagtccccttctccagggcacatgagaaaaacaggcctaacatcaggtctcagcggttcctctcacaggccttggcttggaaggctggagcttcggaccaaggcccagccctgtcacctcctcttcatgtgatgtggacccctgggagcatcagtgtcctcatctgtccaatgacagcccttttctcacagagttattgtgaagattcaacaatttcttggcatagtgcctggcacatggtgtgtgcttagcgcaaatggcagctctcatcatgaatgatagactctttcaccctgctggtcccaggtcggcacacacatccccataatggcatttctcctttctgtgcacagcactttattgttacaaagtactcttccaaaaagttaccctgtgtgtaaaaaaaaaaaaaaaaaaaaa

SEQ ID NO: 128222 - DNA, 1157 bp, Homo sapiens
  Payload ID: 5105
  Gene Symbol: DUSP18
  Gene Name: dual specificity phosphatase 18
  ENST ID: ENST00000342474
  CDS Start-End: 669-1157
acatgcgcacagagcccgggcggctacggaagcggtgagactgtctctcggctgcagccctggtgcgacccggcccgttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagagctttgtttaagactgagaaagtgagggtccgagagtctaatgaatgctctgggcacccaggccgcacctgaggagcaccgacgactgcacggtctgcggcgcgggaagcagatctgcggctgaacctctaccccaattacttagcggcgactgagcctatcgagcagttttccatggacacagcctagcagaaagacgcagccttcgtgcttcgctgactgctgaccactgacccaccgccttgatgacagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggaggtagtgaacaccttgtatgaggatatccagtacatgcaggtacctgtggctgactcccctaactcacgtctctgtgacttctttgaccctattgctgaccatatccacagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacact

SEQ ID NO: 128223 - DNA, 1732 bp, Homo sapiens
  Payload ID: 5105
  Gene Symbol: DUSP18
  Gene Name: dual specificity phosphatase 18
  Uniprot ID: Q8NEJ0
  ENST ID: ENST00000377087
  CDS Start-End: 426-992
gttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagagttttccatggacacagcctagcagaaagacgcagccttcgtgcttcgctgactgctgaccactgacccaccgccttgatgacagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggaggtagtgaacaccttgtatgaggatatccagtacatgcaggtacctgtggctgactcccctaactcacgtctctgtgacttctttgaccctattgctgaccatatccacagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacactgtgcacatggtcagttccccagtgggaatgatccctgacatctatgagaaggaagtccgtttgatgattccactgtgagccatcccacgagcccctgcattggagtcagaggtacagatctattgttgatcttacaccaagatccaaacttgaacattctacttttgttgatacagaaaaaaacagatgatgccttttatgagcacaaaaaagagttgctgtagcttttaactttataatccattttttttaagattaaactaattgtgagatggtgaagataaattttctgccctgtgagtgacactggccaggggataggttgaggcagatggtgcccagaagaaagagggcagcacccattgcacatggcaggcctggaatcctgcagccctccccaaaaacagattgacccaggaatgaatctgctacaattccacctcattctttcacacccagagccagagccttaagcatcatggtacctcttgcgcttcttacagtggtggttcctgctgccctccaggttgtgcatctgaagcctacaagaaagtttgcctacctggggcagctggatcacaaagttggctggaagtaccagacagtgacagccaccctggaggagaagaggaaggagaaggccaagatccactaccagaataagaaacagctcatgggatggccgggcgcggtggctcacgcctgtaatcctagcactttgggaggcggaggcgggcagatcaggaggtcaggagattgagaccatcctggctaacatggtgaaacccagtctctactaaaaaaataaaaaataaaaa

SEQ ID NO: 128224 - DNA, 2920 bp, Homo sapiens
  Payload ID: 5105
  Gene Symbol: DUSP18
  Gene Name: dual specificity phosphatase 18
  ENST ID: ENST00000403268
  CDS Start-End: 472-825
agcggtgagactgtctctcggctgcagccctggtgcgacccggcccgttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagagttttccatggacacagcctagcagaaagacgcagccttcgtgcttcgctgactgctgaccactgacccaccgccttgatgacagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacactgtgcacatggtcagttccccagtgggaatgatccctgacatctatgagaaggaagtccgtttgatgattccactgtgagccatcccacgagcccctgcattggagtcagaggtacagatctattgttgatcttacaccaagatccaaacttgaacattctacttttgttgatacagaaaaaaacagatgatgccttttatgagcacaaaaaagagttgctgtagcttttaactttataatccattttttttaagattaaactaattgtgagatggtgaagataaattttctgccctgtgagtgacactggccaggggataggttgaggcagatggtgcccagaagaaagagggcagcacccattgcacatggcaggcctggaatcctgcagccctccccaaaaacagattgacccaggaatgaatctgctacaattccacctcattctttcacacccagagccagagccttaagcatcatggtacctcttgcgcttcttacagtgagtgccaatctactagataaatggccttcaggcagtgctccaggaatcctggggggtcccaggccacctctgcttccaccttcactataagtggcccagttctggttttctagattgtacttatgcataagatagtttttaaagaaagcattccactgtgtaaatttttttttgtctttttttgaaactgtcctgctctgtcacccatcctagagtgcagtagtgtgatcatggctcactgtagccacaacctctcaggctcaagtgatcctcttaccttagcctcctgcgtggctgggactacagatgtttgccaccatgcccgcctcattttttttctttttttatagagatgagattttactatgtcgcccagactggtctcaaactcctggcctcaagcaatcctcacgcctcagcctcccaaagtgttgatgagccactgtaccccgataccactgtataaaaaatttaaaaaaaattgtgagtgctattgtacatggcaaagtttcaaagagctcttggccatccctcaccaaactttggcaaaagatggtgttagtccccttctccagggcacatgagaaaaacaggcctaacatcaggtctcagcggttcctctcacaggccttggcttggaaggctggagcttcggaccaaggcccagccctgtcacctcctcttcatgtgatgtggacccctgggagcatcagtgtcctcatctgtccaatgacagcccttttctcacagagttattgtgaagattcaacaatttcttggcatagtgcctggcacatggtgtgtgcttagcgcaaatggcagctctcatcatgaatgatagactctttcaccctgctggtcccaggtcggcacacacatccccataatggcatttctcctttctgtgcacagcactttattgttacaaagtactcttccaaaaagttaccctgtgtgtaaaaaaaaaaaaaaaaaaaaatggtttaagtcctttcagaccctacctcacaggaggcctagacttagagccttttgagagcttccgtcttgtttaatctaggtgcaatctagaggtcctgaaacaaggagcacagttccagcttcccccaatcacttctaaacagtgactgcagccttgtttagaatcactatgaaaacctgcaccccggctgactactgggatccataagggggccgtgtcaaagggactaactagtggactccatcagtaggccctggaattcaggattgttcacatcctcttggtgccaaggacctggctgaagaccagctcttctgatccagaggttttcagcaaacagcatttgaaacaaaagcacagctgctctgtttgacaccaaactgtggctccagattccagtagaagccaaatgctttttcttttaacagctgggtgcctgtaatcccagttacttgggaggctgaggcaggagaattgcttgaacccaggaggcggaggttgcagtgagccgagcttgcaccattgcactccagcctgggcaacaagagtgagactccatctcaaaaagaaaaaaaaaaaaaaa

SEQ ID NO: 128225 - DNA, 1306 bp, Homo sapiens
  Payload ID: 5105
  Gene Symbol: DUSP18
  Gene Name: dual specificity phosphatase 18
  Uniprot ID: Q8NEJ0
  ENST ID: ENST00000404885
  CDS Start-End: 460-1026
gtctctcggctgcagccctggtgcgacccggcccgttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagagttttccatggacacagcctagcagaaagacgcagccttcgtgcttcgctgactgctgaccactgacccaccgccttgatgacagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggaggtagtgaacaccttgtatgaggatatccagtacatgcaggtacctgtggctgactcccctaactcacgtctctgtgacttctttgaccctattgctgaccatatccacagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacactgtgcacatggtcagttccccagtgggaatgatccctgacatctatgagaaggaagtccgtttgatgattccactgtgagccatcccacgagcccctgcattggagtcagagcccctgcccttgatggatcagctggcaccacccagattgataaactggctcgtctgatcttgtggcccccacccaggaactgactgggcactagaaaacagcttcaacatcctgtgatttcatccctgaccaatcagcactcctgtctcactggcttcccccaacccaccaagttgtccttaaaactctgctccctgaatggtcggggagactgatttcagtaatagtaaaactctggtctcctgca

SEQ ID NO: 128226 - DNA, 1978 bp, Homo sapiens
  Payload ID: 5105
  Gene Symbol: DUSP18
  Gene Name: dual specificity phosphatase 18
  Uniprot ID: Q8NEJ0
  ENST ID: ENST00000407308
  CDS Start-End: 1132-1698
acggaagcggtgagactgtctctcggctgcagccctggtgcgacccggcccgttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagaggtaaaaccctgggggtcctgacactaagcaggcgaagaagcctattccaatgccagctcccctaggaaacctacccggcccacccctagaagtgatgcttcgctctcgttaactcttggactttgttccatgtttataacttagtatttcacgaacgccccgcggtgtttgttcatttttcccacacataatggaccataaaggtcggcttctttgctttatgactcgttctgaacaagtccttttccgcgctgtgtctcactttcctcttttgtaaaatggaaatattaactctagacgccggtctgattaggttgctttgaagatcgaaccagatgagggaagccaaatacttcataggctgtaaagtggtgaagctgaactgctaccgagttgctatttttttctcctcctccctctcaagctaaacgttctttagatcttttgtgatttcttcaggtggtctttgcgactccctaggctccgacctggaagaaatcttttttacacttccctttcacagagccctgcattttaacttccctatcagaagcgagaaaaatagttatcattttgagagggcttactctatgccaagccctgagaaaactctttacgtggattatctcgtttaatttcacaacatccttttaagttttccatggacacagcctagcagaaagacgcagccttcgtgcttcgctgactgctgaccactgacccaccgccttgatgacagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggaggtagtgaacaccttgtatgaggatatccagtacatgcaggtacctgtggctgactcccctaactcacgtctctgtgacttctttgaccctattgctgaccatatccacagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacactgtgcacatggtcagttccccagtgggaatgatccctgacatctatgagaaggaagtccgtttgatgattccactgtgagccatcccacgagcccctgcattggagtcagagcccctgcccttgatggatcagctggcaccacccagattgataaactggctcgtctgatcttgtggcccccacccaggaactgactgggcactagaaaacagcttcaacatcctgtgatttcatccctgaccaatcagcactcctgtctcactggcttcccccaacccaccaagttgtccttaaaactctgctccctgaatggtcggggagactgatttcagtaatagtaaaactctggtctcctgca

SEQ ID NO: 128227 - DNA, 699 bp, Homo sapiens
  Payload ID: 5105
  Gene Symbol: DUSP18
  Gene Name: dual specificity phosphatase 18
  ENST ID: ENST00000412865
  CDS Start-End: 1-21
cgtttgatgattccactgtgagccatcccacgagcccctgcattggagtcagaggtacagatctattgttgatcttacaccaagatccaaacttgaacattctacttttgttgatacagaaaaaaacagatgatgccttttatgagcacaaaaaagagttgctgtagcttttaactttataatccattttttttaagattaaactaattgtgagatggtgaagataaattttctgccctgtgagtgacactggccaggggataggttgaggcagatggtgcccagaagaaagagggcagcacccattgcacatggcaggcctggaatcctgcagccctccccaaaaacagattgacccaggaatgaatctgctacaattccacctcattctttcacacccagagccagagccttaagcatcatggtacctcttgcgcttcttacagttgtgcatctgaagcctacaagaaagtttgcctacctggggcagctggatcacaaagttggctggaagtaccagacagtgacagccaccctggaggagaagaggaaggagaaggccaagatccactaccagaataagaaacagctcatgggatggccgggcgcggtggctcacgcctgtaatcctagcactttgggaggcggaggcgggcagatcaggaggtcaggagattgagaccatcctggctaacatgg

SEQ ID NO: 128228 - DNA, 657 bp, Homo sapiens
  Payload ID: 5105
  Gene Symbol: DUSP18
  Gene Name: dual specificity phosphatase 18
  ENST ID: ENST00000442752
  CDS Start-End: 625-657
ttaactcttggactttgttccatgtttataacttagtatttcacgaacgccccgcggtgtttgttcatttttcccacacataatggaccataaaggtcggcttctttgctttatgactcgttctgaacaagtccttttccgcgctgtgtctcactttcctcttttgtaaaatggaaatattaactctagacgccggtctgattaggttgctttgaagatcgaaccagatgagggaagccaaatacttcataggctgtaaagtggtgaagctgaactgctaccgagttgctatttttttctcctcctccctctcaagctaaacgttctttagatcttttgtgatttcttcaggtggtctttgcgactccctaggctccgacctggaagaaatcttttttacacttccctttcacagagccctgcattttaacttccctatcagaagcgagaaaaatagttatcattttgagagggcttactctatgccaagccctgagaaaactctttacgtggattatctcgtttaatttcacaacatccttttaagttttccatggacacagcctagcagaaagacgcagccttcgtgcttcgctgactgctgaccactgacccaccgccttgatgacagcaccctcgtgtgccttcccagttcag

SEQ ID NO: 128229 - DNA, 598 bp, Homo sapiens
  Payload ID: 5105
  Gene Symbol: DUSP18
  Gene Name: dual specificity phosphatase 18
  ENST ID: ENST00000430175
  CDS Start-End: 1-70
ggtcagttccccagtgggaatgatccctgacatctatgagaaggaagtccgtttgatgattccactgtgagccatcccacgagcccctgcattggagtcagagattaaactaattgtgagatggtgaagataaattttctgccctgtgagtgacactggccaggggataggttgaggcagatggtgcccagaagaaagagggcagcacccattgcacatggcaggcctggaatcctgcagccctccccaaaaacagattgacccaggaatgaatctgctacaattccacctcattctttcacacccagagccagagccttaagcatcatggtacctcttgcgcttcttacacccctgcccttgatggatcagctggcaccacccagattgataaactggctcgtctgatcttgtggcccccacccaggaactgactgggcactagaaaacagcttcaacatcctgtgatttcatccctgaccaatcagcactcctgtctcactggcttcccccaacccaccaagttgtccttaaaactctgctccctgaatggtcggggagactgatttcagtaatagtaaaactctggtctcctgca

SEQ ID NO: 128230 - DNA, 1117 bp, Homo sapiens
  Payload ID: 5106
  Gene Symbol: DUSP19
  Gene Name: dual specificity phosphatase 19
  Uniprot ID: Q8WTR2
  ENST ID: ENST00000342619
  CDS Start-End: 376-876
tctccaacgaagtcttatattttaccattctgcgtgtattagaaagctaaatttaaacagcaacaataagaaatcttccccagtggatccctcgagcctttcgggaaaatgcaggtttctggctgacaggaagaagaaacagcatccaatcggcacttgtgtctcaatgaccaatcaaatttcgccttacattgcatcgctgggataaacggagctggacgactcagtctcttggtctgtggctgctgcggttacctggatgggcgagcacctctgaggctggctttgttacctgggcaataagggactagcagttcagccgttttctatgcctgctggatttgtttgtatttgttcccagccactgctcatgtaatgtactcccttaaccaggaaattaaagcattctcccggaataatctcaggaagcaatgcaccagggtgacaacgctaactggaaagaaaattatagaaacatggaaagatgccagaattcatgttgtggaagaagtagagccgagcagtgggggtggttgtggttatgtgcaggaccttagctcggacctgcaagttggcgttattaagccatggttgctcctagggtcacaagatgctgctcatgatttggatacactgaaaaagaataaggatggagtggttcttgttcattgtaatgcaggcgtttccagggctgctgcaattgtaataggtttcctgatgaattctgaacaaacctcatttaccagtgctttttctttggtgaaaaatgcaagaccttccatatgtccaaattctggcttcatggagcagcttcgtacatatcaagagggcaaagaaagcaataagtgtgacagaatacaggagaacagttcatgagttgcattgtagcagacaatggacaactgtagtttctgaattgacttctatagccatcttttcccttttttggagagtagactagcaaaactcccttttttctcttgccttttttatgcataaatggaggtcaatttgattgtcctgacctactgtataagtaaatttcaaatgtcattactttctctttgttattataatgtgtgattaaatgcttttttaaattgctaagggaaaataa

SEQ ID NO: 128231 - DNA, 5176 bp, Homo sapiens
  Payload ID: 5106
  Gene Symbol: DUSP19
  Gene Name: dual specificity phosphatase 19
  Uniprot ID: Q8WTR2
  ENST ID: ENST00000354221
  CDS Start-End: 176-829
tgggataaacggagctggacgactcagtctcttggtctgtggctgctgcggttacctggatgggcgagcacctctgaggctggctttgttacctgggcaataagggactagcagttcagccgttttctatgcctgctggatttgtttgtatttgttcccagccactgctcatgtaatgtactcccttaaccaggaaattaaagcattctcccggaataatctcaggaagcaatgcaccagggtgacaacgctaactggaaagaaaattatagaaacatggaaagatgccagaattcatgttgtggaagaagtagagccgagcagtgggggtggttgtggttatgtgcaggaccttagctcggacctgcaagttggcgttattaagccatggttgctcctagggtcacaagatgctgctcatgatttggatacactgaaaaagaataaggtgactcatattcttaatgttgcatatggagttgaaaatgctttcctcagtgactttacatataagagcatttctatattggatctgcctgaaaccaacatcctgtcttattttccagaatgttttgaatttattgaagaagcaaaaagaaaagatggagtggttcttgttcattgtaatgcaggcgtttccagggctgctgcaattgtaataggtttcctgatgaattctgaacaaacctcatttaccagtgctttttctttggtgaaaaatgcaagaccttccatatgtccaaattctggcttcatggagcagcttcgtacatatcaagagggcaaagaaagcaataagtgtgacagaatacaggagaacagttcatgagttgcattgtagcagacaatggacaactgtagtttctgaattgacttctatagccatcttttcccttttttggagagtagactagcaaaactcccttttttctcttgccttttttatgcataaatggaggtcaatttgattgtcctgacctactgtataagtaaatttcaaatgtcattactttctctttgttattataatgtgtgattaaatgcttttttaaattgctaagggaaaataacaaagtgttagtaatcattgctttctgtagaagaaaaaggtttaaatttaaaatgtgtatttagagcatggagagaatcatttaatgaagcctatttttctgttccagcaactgtttttatgaaagaaaaacttgaaatgctacttaacttactatttcaaagggaagtatatttctttttaaagaatctttttaagattaaaaatgaataccttaaatctcccaaaagagataaccagtatctgaaggtttatacaatatttacacagtggctacaatattcacaaaattcttatgttctcttatgaaaaatatacacttttcattttgtcttcttctttttttttctttttttagatggagtttggctcttgtcacccaggctggagtgcaatggcgcaatctcagctcactgcaacctctgcctcccgggttcaagcgattctcctgccccagcctcccatatagctgggattataggtgcctgccaccatgcccagctaatttttgtgtttttagtagagatggagtctcaccacataggccaggcagtctcgaactcctgacctcaggtgatccacccaccttggcctctctaaatactgggattacaggcgtgagccactgcatccgacctcattttgtttttttcaattctgttatcggcatttctttctttttttttttaatgtataggtgttctgtcatacgttattgtgagctttggttctttgaacaggtgatctattctcttacattttgtgctttttatcttgggtgcctagcattctgtttttttgatcctatgtcataattttttgagaaaatgtttgatactgcaagatcattgtttagtggtctgttttctacttcagtattctaccagagaacatattttttaggggagaagggttatggttttgtaagaaactttaaatatacttttaggagacccacaatcatttacagttttatctttggcctttgaataggttcttttttctttaatgtctccgtatttgaagaactgagctctgtacattataaatttgcttaaagattttgattttttcttcagaatatggtatacttaaaattaattaattaagacagtttcttttttcttttcttttttttttttttcgagacagggtcttgctctgtcacctaggctagagtggagtggcatgaacacaacgcactgcagcctctacctcctgggctcaagcagtcctcccacctcagtctcctgagtagctgagactacagctgtgcgccaccacatctggctaattttatttttatttttgtagagacaggagtcttgccatgttgcccaggctgatctcaaactcctaggcttaagtgatcctcccgccttagcctcccaagtgctaggattacaggcatcagccaccacgcctggcctgatagtttccacatagtttttcatgacttagaagatatcattgccatgtaggttttatttttaaaagtcttgagctcttcttaaatatacattataaagagcaagcatagatggaaagtgcatattgaacacatctgtgcatttgagaaggcaggctttcatatgctgtcatgagcaaaaagtagaagtgataaatgcaagttatgttttgagattgcttacaccgtgacaagatgccatcacttgtgatgttatgaactgttataaactctttgcttctgctaagaagcagtctaaatataatcaacgtacagtgagctctttgaagccaaccaaggcaggcagaaccctcttaaatatgagactgatgtataggttctctctatggtcagtatcactggataagccttctcctttcataagaaaggatgtatttaaatacattttattttgctaaatcctgtttagttttcagccattaaatgtcacatgaagccttgatagaatttgttcataatggctcatgtattattattatttttgagatggagttttgctcttaatgatattattattatttgagacagagttttgctcttattgcccaggctggagtgcagtggcgtgatcttggctcactgcaacctctgcctcccagcttcaagcgattctcctgtatcagcctcccaagtagctgggattataggcatgtgccaccatgcccagcaaattttgtatttttttttggtagagacagggttcaaccatgttggtcaggctggtctcgaactcctgaccgcaagtgatccacacgccttggtctcccaaagtgctgggattacggtgttagccactacacctggcctggattgtgtattatttatgtctgtagtttatatgcttagttgttgcctatagtgatctgggtaagattcaaacatttatcttttgtatcttctacagaagtgctttgagcatcaaatttgttttaacgttaaattgtagtttgctgtattaaaatagatcaatgaatataattcagtcttttaggggcaccaagtaaagcataaggtcatatatactatacaatatgtttattgcacttcccatggggataaatcactctgtcattcctagttattttaaaaaaagaactttatgattacggtcctctttctcacatactgcaaacttaaaagatacatacaccaaatataggtctgttttaaaggagaggaaaaatagttcaaggagtttttgcctctttgtttttcaatagattattctgccattttttaaaggaaagggaaaatgaaaacagcatgtctttttaaacattgaaaagaaatatggaggctttaaaccgcaaactgaaaaagctgagtagaacaaaggcagtggagcatacaatacaattctatttatttgaggttaattgaagttaataatttttaaatttttttctaattttatgccttaaaataggtttctgattacataaaatttgaatagaacactcaagaagtatgtagatttttgaaaaacccaaacaatattcttcttagatttttggaggcaaaatttagaccagtatactaattcaaaagacaaatatttcagaggaagtggagtacagtatttaacattttgtttgcaattttactttttcttcccttcttccctattgaaccttgattaaaatgtatgaatacaatacttggatttttttttttcagcttagactctgataatttcagtggtagtggggaaacctgaatttgtcagcatgattatttgtaactcagattgttcaaatgtatatagaaggtccccttcaagtgttgtttctccaagtagtcataaatgtagcaagtataaatcagaatatcatcttataatcttacagagttaacctaatgagtcaatacctttataagcaaaaccatgataaatttaaaaacaacagaaatgtggcatgattacttatttatttgttccaggtgactctaaatagttgatttttctgcctgaaggatcctgaacatatttagttaccctgtagttatttaggaatttaaaccagaagactttgaagttgtatattcttgcaatgcataaaatgacattataatcaacaaacttatggtttgtttcaattgatgcacacaaaaaataacttatagttagacttttctatttcaagtaaagctttgagttacttgtttttatacatattcatcatgtaccctttattgtttctaggtgttgatatactttaataaaaatgatatgtttaatattttcccattaatatatttctttgaagctatttgttttaaaagatgtaacacttatttgctgtcaaattctgaattaaaaaatctgttggtggccaggcgcagtggctcatgcctgtaatcccaacattttgggaggccaaggagatggatcacttgaggccaggagttcaagaccagcctggccaacatggcaaaaccccatcactaaaaatacaaaaattacccgggcatggtggtgggtgcctgtaatcccagcttcttaggaggctgaggtaggagaattgcttgaccctgggaggtggaggtggcagtgagccgagatagcaccactgcacttctagttgacagagtgagactctgactcaaaaaaaaaaaaa

SEQ ID NO: 128232 - DNA, 1688 bp, Homo sapiens
  Payload ID: 5107
  Gene Symbol: DUSP2
  Gene Name: dual specificity phosphatase 2
  Uniprot ID: Q05923
  ENST ID: ENST00000288943
  CDS Start-End: 87-1031
ggagtcgaccgctcgggcagcgccaccgccacgagagcccgggacgcgggaaagaccgaaaggaagaggaagaggcaccggtggccatggggctggaggcggcgcgcgagctggagtgcgcggcgctgggcacgctgctgcgggatccgcgggaggcggaacgcacgctgctgctggactgccgccccttcctggccttctgccggcgccacgtgcgcgccgcgcggccagtgccttggaacgcgctgctgcggcgccgcgcgcgcggccctcctgccgccgttctcgcctgcctgctgcccgaccgcgcgctgcggacgcgcctggtccgcggggagctggcgcgggccgtggtgctggacgagggcagtgcctcggtggcggagctccggcccgacagcccggctcatgtgctgctggccgcgctgctgcacgagacccgcgcggggcccactgccgtgtacttcctgcgaggaggcttcgacggcttccagggctgctgtcccgatctgtgctctgaggcccccgcccctgcgctgccgccaacaggggacaaaaccagccgctccgactccagggctcctgtctacgaccagggtggccctgtggagatcttgccctacctgttcctgggcagctgcagtcactcgtcagacctgcaggggctgcaggcctgtggcatcacagccgtcctcaacgtgtccgccagctgccccaaccactttgagggccttttccgctacaagagtatccctgtggaggacaaccagatggtggagatcagtgcctggttccaggaggccataggcttcattgactgggtgaagaacagcggaggccgggtgctggtgcactgccaggcgggtatctcgcgctctgccaccatctgtctggcatacctcatgcagagtcgccgtgtgcggctggacgaggcctttgacttcgttaagcagcgccggggggtcatctcccccaacttcagtttcatggggcagctgctgcagtttgagacccaggtgctgtgtcactgaggtggtgcccctctgcctgcctgccccactgtgctggcaggagctgactgtggactggtgggctcccctctgggccagcacagtcccctcacctctggcagggctgctacctcctcagagtttcagaagcccccacatgggggctctaggaatgccggcatgctggtctttccgacctggtgctcttctgctgggggactgaggctggccctcattcggggtcgggaaccaagggtgtgtctgctctttccctccccatcctctggcagaaatcagctagacgctataccgtggactctccctggtccaccaccatgttgaagcccttggcagcctgagagctccaaggaacaagctgtgacaaccaggagccctgtctgtgggttcgtctgcccagggcctggagcccaagccctgtgttcctggggaagctggggacttgggaagtgatgggtgtgtcatgttgcgtgtgtctgtctgtgagcctttcacacctgtgctggcgctggaaaattatttgtgctcagctgacatttaacactccctcccccgcttcctcctagccctgtgggcaggggttggaaacttagcactttatatttatacagaacattcaggatatgtcaataaaatattgttatatttaaaaaacaacaa

SEQ ID NO: 128233 - DNA, 885 bp, Homo sapiens
  Payload ID: 5108
  Gene Symbol: DUSP21
  Gene Name: dual specificity phosphatase 21
  Uniprot ID: Q9H596
  ENST ID: ENST00000339042
  CDS Start-End: 130-702
gtggccgatagctggtcctctttctccaacacctagcctgagacttggcggcgcggctgctatcctgaactagcttggtaagtgttgtgtcccgaaccagcgtagagagacctcggaccagccgccttgatgacagcatccgcgtcctccttttcatcatctcagggtgtccagcagccctccatctacagcttctcccaaataaccagaagcttgtttctcagcaatggtgtggccgccaacgacaaactccttctgtccagcaatcgcatcaccgccattgtcaatgcctcggtggaagtggtcaacgtattcttcgagggcattcagtacataaaggtgcctgttaccgatgctcgtgactcgcgtctctacgacttttttgaccccattgctgatcttatccacaccatcgatatgaggcagggccgtacgctgctgcactgcatggctggagtgagccgttccgcctcactgtgccttgcgtacctcatgaaataccactccatgtcgctgctggacgcccatacatggaccaagtcgcgccgccccatcatccggcccaacaacggcttttgggaacagctcatcaattacgaattcaagctgtttaataacaacaccgtgcgcatgatcaactcgccggtaggtaacatccctgacatctatgagaaggacctacgtatgatgatatcaatgtaagccatcccggccagcccctgacatctgccatcgatcttgcaccaagactgaacttgaacactgacattttgttagtaaagaaaaccggatggtgccttgttaaagggcaagaaaaaagggagggggttggagttttgaacgtagtaagccttaccttaatagaattaaattcatgaaacataa

SEQ ID NO: 128234 - DNA, 1485 bp, Homo sapiens
  Payload ID: 5109
  Gene Symbol: DUSP22
  Gene Name: dual specificity phosphatase 22
  Uniprot ID: Q9NRW4
  ENST ID: ENST00000344450
  CDS Start-End: 444-998
gagcccgagcctagtgcctcccacgcccggcggccgcgagccggggtccgcgagggcggagtggggcgcggcagccaggaacccgactacgaatcccagggtgcgggcgggcggagcgaggagggacgctgggcctgcccggtgcgcacgggggcggggaccggcaaggcgggaccatttcccggcataggctccggtgcccctgcccggctcccgccgggaagttctaggccgccgcacagaaagccctgccctccacgccgggtctctggagcgccctgggttgcccggccggtccctgccgctgacttgttgacactgcgagcactcagtccctcccgcgcgcctcctccccgcccgccccgccgctcctcctccctgtaacatgccatagtgcgcctgcgaccacacggccggggcgctagcgttcgccttcagccaccatggggaatgggatgaacaagatcctgcccggcctgtacatcggcaacttcaaagatgccagagacgcggaacaattgagcaagaacaaggtgacacatattctgtctgtccacgatagtgccaggcctatgttggagggagttaaatacctgtgcatcccagcagcggattcaccatctcaaaacctgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctggccgctccgggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagtttaa

SEQ ID NO: 128235 - DNA, 3098 bp, Homo sapiens
  Payload ID: 5109
  Gene Symbol: DUSP22
  Gene Name: dual specificity phosphatase 22
  Uniprot ID: Q9NRW4
  ENST ID: ENST00000419235
  CDS Start-End: 79-696
ccgctcctcctccctgtaacatgccatagtgcgcctgcgaccacacggccggggcgctagcgttcgccttcagccaccatggggaatgggatgaacaagatcctgcccggcctgtacatcggcaacttcaaagatgccagagacgcggaacaattgagcaagaacaaggtgacacatattctgtctgtccacgatagtgccaggcctatgttggagggagttaaatacctgtgcatcccagcagcggattcaccatctcaaaacctgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctgggtaaatataaggagcaagggcgcacagagccccagcccggcgccaggcggtggagcagttttccggcactggctccgctgacctacgataattatacgacggagacctaacgcaagcgacctgctgccttccttcccactgcttgtcttcagtgtgcccggctgggcaggggtgcggtggtggtggccgatgaggacaggaaagggagatagccagggcgaggtggggcgagggctccttcccccaagcaacaccgcccagccctgctccaggcccctgcactccgcccacccctaccctggctgcacctgagcttgctgcccctggggatgttgcccagtggctgtgcactgctctgtgcacgtgcgtgtgtgtgagtgcacttgtgtgtgggtgactaagtggatgcatgtgtgtgcctgtgtgagtgagggtatgtgcacctaagtgtgtacatgtgtgtatgttgtgaaagtgtctgtgcacatgaatgtttgtgtgtgtgtgaactctttcttactgctggaagtcacagaattcatattgctgcccgggttggtgtggccacctttccctttgtccaagactccacatggaaggcatttgagctcgacctccgaaaagctacccagcaaagagcagtctgtgcctctgagcagaccgtgagaactcaggggacgagtggctaagagcatggcctctcccagaacccacccagggtggtgtggtgggggcaacaggggccagactcctctagagggagggtggctctggggccctggaaaacgtgagagactgccctgagctggtccagtgggccagcactttataccaactcagcatttaagggaagtatcttagattgcctccatctcaatgtgaatgcaccaggctgagggttccctagcgccttgagtcaaggccacttttcagcccatcgagccctgagttctacttggtgtttgttctctggagctgattgcacttgagctctgtggtgggcaggcgcactttagcctaagttgggtgccccagggcaccccctcctctctgctccttgccagcttcattcactcccagcctctcgctgtcctcactttgcaggggctcctcctcaacatttgcatgcacctgcaagaattgggaagaaagagcatttattaggcactgtagcaatttgcattttaaaatgcctgagcatttattaagcttcttggtattcacttgggtttgataattgatctgagctacctcattgaatgtttttggaaaggtgttttttggtatgcaagtcagctttgcctcacagttgaaaatgttcggtcatgattgcttttgaaaccaaaggggaaggtaccgatatcattgagctatttaaagttgccagtttgggctccagtaatgctttctggtgggtaaaattccacattcaggccacgagagcatctacagtttgtactctggggctgcaggcatcctgggacgctgtacgcaattcagtggtctagtcctttataccgactcagattccttaagcatgcagagtcactcgaatgaaaaaacatactcgacctctccctaaaaagatgttgcaacccagtttctctgaattccaccacaaaaagagaccctgaataagaagagcagttttcctgtgcatatagagggtgtgtcaaaggtgagctttttggggaccgggaaaaacaaagttgcctgattccgcgcaggtgcacaggccccggatgtacacccggaaaggggagtgtggctgtagaatcatccatccgtctacagctaaaacaatttgccaataaagtacatgtttttcctaagccaaaaataaatacgttaacagaaaaatgatttaggatatagcttgaatgcttaaatatgtgcacctttacaaacctctcagtgtattcttggagttcttgaaatgttgttttaatatttgttgccagtaatgttctttcttcacagccgctccgggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagttt

SEQ ID NO: 128236 - DNA, 551 bp, Homo sapiens
  Payload ID: 5109
  Gene Symbol: DUSP22
  Gene Name: dual specificity phosphatase 22
  ENST ID: ENST00000605863
  CDS Start-End: 204-344
aacatgccatagtgcgcctgcgaccacacggccggggcgctagcgttcgccttcagccaccatggggaatgggatgaacaaggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcaggtaagcagttcttaggggacatcagagatgcaggcaggtgcccctgaacggtgcccacagtctttccgtacacagccagcatcatggcgtttggagttgaaaggcccacagaggacatcggctcccagggcgcccagctgcaccccttcagaagtcgtcacgatccctcgtgcacctgttgaagccacaggcgcctaccctttgtcattctccttgtgcctg

SEQ ID NO: 128237 - DNA, 405 bp, Homo sapiens
  Payload ID: 5109
  Gene Symbol: DUSP22
  Gene Name: dual specificity phosphatase 22
  ENST ID: ENST00000603296
  CDS Start-End: 180-405
aggccgtgaggtctgaggtcagagatccagccatctgctcccccagggtagggaggtcgggcctccccgggatcctgcccggcctgtacatcggcaacttcaaagatgccagagacgcggaacaattgagcaagaacaaggtgacacatattctgtctgtccacgatagtgccaggcctatgttggagggagttaaatacctgtgcatcccagcagcggattcaccatctcaaaacctgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgc

SEQ ID NO: 128238 - DNA, 587 bp, Homo sapiens
  Payload ID: 5109
  Gene Symbol: DUSP22
  Gene Name: dual specificity phosphatase 22
  ENST ID: ENST00000603726
  CDS Start-End: 1-165
atggggaatgggatgaacaagatcctgcccggcctgtacatcggcaacttcaaagatgccagagacgcggaacaattgagcaagaacaaggtgacacatattctgtctgtccacgatagtgccaggcctatgttggaggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctggccgctccgggaattctgaagttctgggcctttctcagaagactgtaatgtacctgaagtttctgaaatattgcaaacccacagagtttaggctggtgctgccaaaaagaaaagcaacatagagtttaag

SEQ ID NO: 128239 - DNA, 465 bp, Homo sapiens
  Payload ID: 5109
  Gene Symbol: DUSP22
  Gene Name: dual specificity phosphatase 22
  ENST ID: ENST00000603881
  CDS Start-End: 410-465
ccggccggtccctgccgctgacttgttgacactgcgagcactcagtccctcccgcgcgcctcctccccgcccgccccgccgctcctcctccctgtaacatgccatagtgcgcctgcgaccacacggccggggcgctagcgttcgccttcagccaccatggggaatgggatgaacaagatgccagagacgcggaacaattgagcaagaacaaggtgacacatattctgtctgtccacgatagtgccaggcctatgttggaggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttc

SEQ ID NO: 128240 - DNA, 3824 bp, Homo sapiens
  Payload ID: 5109
  Gene Symbol: DUSP22
  Gene Name: dual specificity phosphatase 22
  ENST ID: ENST00000604971
  CDS Start-End: 1114-1422
agtgctgtatctgctggtgcctggagagtcatctgccctgggcttccgcgtcctggtgtgtgcagtgctatatctgctggtgcctggagagtcatctgccctgggcttccgcgtcctggtgtgtgcaatgctgtatctgcgggtgcctggagagtcatctgccctgggcttctgcatcctggtgtgtgcagtgctgtatctgctggtgcctggagtcatctgccctgggcttctgcgtcctggtgtgtgcagtgctgtacctgctggtgcctggagagtcatctgccctgggcttccgtatcctggtgtgtgcagtgctgtatctgctggtgcctggagagtcatctgccctgggcttccgcgtcctggtgtgtgcaatgctgtatctgcgggtgcctggagagtcatctgccctgggcttctgcatcctggtgtgtgcaatgctgtatctgctggtgcctggagtcatctgccctgggcttctgcatcctcgtgtgtgcagtgctgtacctgctggtgcctggagtcatctgccctgggcttccgcatcctcgtgtgtgcagtgctgtacctgctggtgcctggagagtcatctgccctgggcttctgcgttctggtgtgtgcagtgctgtatctgctggtgcctggagagtcatctgccctgggcttccgcgtcctggtgtgtgcaatgctgtatctgctggtgtctggagtcatcttccctgggcttctgcgtcctggtgtgtgcagtgctgtatctgctggtgcctggagagtcatctgcgctgggcttctgcgtcctggtgtgtgcaatgctgtatctgctggtgcctggagagtcatctgccctgggcttctgcgttctggtgtgtgcagtgctgtatctgctggtgcctggagagtcatctgccctgggcttccccgtcctggtgtgtgcaatgctgtatctgctggtgcctggagagtcgtcttccctcggcttctgtgtcctggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctgggtaaatataaggagcaagggcgcacagagccccagcccggcgccaggcggtggagcagttttccggcactggctccgctgacctacgataattatacgacggagacctaacgcaagcgacctgctgccttccttcccactgcttgtcttcagtgtgcccggctgggcaggggtgcggtggtggtggccgatgaggacaggaaagggagatagccagggcgaggtggggcgagggctccttcccccaagcaacaccgcccagccctgctccaggcccctgcactccgcccacccctaccctggctgcacctgagcttgctgcccctggggatgttgcccagtggctgtgcactgctctgtgcacgtgcgtgtgtgtgagtgcacttgtgtgtgggtgactaagtggatgcatgtgtgtgcctgtgtgagtgagggtatgtgcacctaagtgtgtacatgtgtgtatgttgtgaaagtgtctgtgcacatgaatgtttgtgtgtgtgtgaactctttcttactgctggaagtcacagaattcatattgctgcccgggttggtgtggccacctttccctttgtccaagactccacatggaaggcatttgagctcgacctccgaaaagctacccagcaaagagcagtctgtgcctctgagcagaccgtgagaactcaggggacgagtggctaagagcatggcctctcccagaacccacccagggtggtgtggtgggggcaacaggggccagactcctctagagggagggtggctctggggccctggaaaacgtgagagactgccctgagctggtccagtgggccagcactttataccaactcagcatttaagggaagtatcttagattgcctccatctcaatgtgaatgcaccaggctgagggttccctagcgccttgagtcaaggccacttttcagcccatcgagccctgagttctacttggtgtttgttctctggagctgattgcacttgagctctgtggtgggcaggcgcactttagcctaagttgggtgccccagggcaccccctcctctctgctccttgccagcttcattcactcccagcctctcgctgtcctcactttgcaggggctcctcctcaacatttgcatgcacctgcaagaattgggaagaaagagcatttattaggcactgtagcaatttgcattttaaaatgcctgagcatttattaagcttcttggtattcacttgggtttgataattgatctgagctacctcattgaatgtttttggaaaggtgttttttggtatgcaagtcagctttgcctcacagttgaaaatgttcggtcatgattgcttttgaaaccaaaggggaaggtaccgatatcattgagctatttaaagttgccagtttgggctccagtaatgctttctggtgggtaaaattccacattcaggccacgagagcatctacagtttgtactctggggctgcaggcatcctgggacgctgtacgcaattcagtggtctagtcctttataccgactcagattccttaagcatgcagagtcactcgaatgaaaaaacatactcgacctctccctaaaaagatgttgcaacccagtttctctgaattccaccacaaaaagagaccctgaataagaagagcagttttcctgtgcatatagagggtgtgtcaaaggtgagctttttggggaccgggaaaaacaaagttgcctgattccgcgcaggtgcacaggccccggatgtacacccggaaaggggagtgtggctgtagaatcatccatccgtctacagctaaaacaatttgccaataaagtacatgtttttcctaagccaaaaataaatacgttaacagaaaaatgatttaggatatagcttgaatgcttaaatatgtgcacctttacaaacctctcagtgtattcttggagttcttgaaatgttgttttaatatttgttgccagtaatgttctttcttcacagccgctccgggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagttt

SEQ ID NO: 128241 - DNA, 804 bp, Homo sapiens
  Payload ID: 5109
  Gene Symbol: DUSP22
  Gene Name: dual specificity phosphatase 22
  ENST ID: ENST00000603453
  CDS Start-End: 493-801
tttcccggcataggctccggtgcccctgcccggctcccgccgggaagttctaggccgccgcacagaaagccctgccctccacgccgggtctctggagcgccctgggttgcccggccggtccctgccgctgacttgttgacactgcgagcactcagtccctcccgcgcgcctcctccccgcccgccccgccgctcctcctccctgtaacatgccatagtgcgcctgcgaccacacggccggggcgctagcgttcgccttcagccaccatggggaatgggatgaacaagatcctgcccggcctgtacatcggcaacttcaaagggagttaaatacctgtgcatcccagcagcggattcaccatctcaaaacctgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctgggtaaatataaggagcaagggcgcacagagccccagcccggcgccaggcggtggagcagttttccggcactggctccgctgacctacgataattatacgacggagacctaacgc

SEQ ID NO: 128242 - DNA, 867 bp, Homo sapiens
  Payload ID: 5109
  Gene Symbol: DUSP22
  Gene Name: dual specificity phosphatase 22
  ENST ID: ENST00000605315
  CDS Start-End: 408-716
ttcccggcataggctccggtgcccctgcccggctcccgccgggaagttctaggccgccgcacagaaagccctgccctccacgccgggtctctggagcgccctgggttgcccggccggtccctgccgctgacttgttgacactgcgagcactcagtccctcccgcgcgcctcctccccgcccgccccgccgctcctcctccctgtaacatgccatagtgcgcctgcgaccacacggccggggcgctagcgttcgccttcagccaccatggggaatgggatgaacaaggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctgggtaaatataaggagcaagggcgcacagagccccagcccggcgccaggcggtggagcagttttccggcactggctccgctgacctacgataattatacgacggagacctaacgcaagcgacctgctgccttccttcccactgcttgtcttcagtgtgcccggctgggcaggggtgcggtggtggtggccgatgaggacaggaaagggagatagccagggcgaggtggggcgagggctccttcccccaagcaacaccgcccag

SEQ ID NO: 128243 - DNA, 1231 bp, Homo sapiens
  Payload ID: 5109
  Gene Symbol: DUSP22
  Gene Name: dual specificity phosphatase 22
  ENST ID: ENST00000605035
  CDS Start-End: 323-463
gtaacatgccatagtgcgcctgcgaccacacggccggggcgctagcgttcgccttcagccaccatggggaatgggatgaacaagatcctgcccggcctgtacatcggcaacttcaaagatgccagagacgcggaacaattgagcaagaacaaggtgacacatattctgtctgtccacgatagtgccaggcctatgttggaggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcaggtaagcagttcttaggggacatcagagatgcaggcaggtgcccctgaacggtgcccacagtctttccgtacacagccagcatcatggcgtttggagttgaaaggcccacagaggacatcggctcccagggcgcccagctgcaccccttcagaagtcgtcacgatccctcgtgcacctgttgaagccacaggcgcctaccctttgtcattctccttgtgcctggtactccctactagtttgtttctctccctttgggtgacgtaccatttccttggtctggcctattttcatgtcctaggccagcaccttgaaggagcagttccttctcttgcttgaccctggctggccaaccacagagctctgatttcccactgctgtttgtttccctggttatgtgtggcaccatctctgtggtgaagtcacaggtgcaagcccacgtggatgcagacgtgcacatgtgtgtgacgtttcgggtttgtttccatcctctccagtatcggcagtggctgaaggaagaatatggagagagccctttgcaggatgcagaagaagccaaaaacattctgggtaaatataaggagcaagggcgcacagagccccagcccggcgccaggcggtggagcagttttccggcactggctccgctgacctacgataattatacgacggagacctaacgcaagcgacctgctgccttccttcccactgcttgtcttcagtgtgcccggctgggcaggggtgcggtggtggtggccgatgaggacaggaaagggagatagccag

SEQ ID NO: 128244 - DNA, 1166 bp, Homo sapiens
  Payload ID: 5109
  Gene Symbol: DUSP22
  Gene Name: dual specificity phosphatase 22
  ENST ID: ENST00000603795
  CDS Start-End: 79-243
ccgctcctcctccctgtaacatgccatagtgcgcctgcgaccacacggccggggcgctagcgttcgccttcagccaccatggggaatgggatgaacaagatcctgcccggcctgtacatcggcaacttcaaagatgccagagacgcggaacaattgagcaagaacaaggtgacacatattctgtctgtccacgatagtgccaggcctatgttggaggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctgggtaaatataaggagcaagggcgcacagagccccagcccggcgccaggcggtggagcagttttccggcactggctccgctgacctacgataattatacgacggagacctaacgcaagcgacctgctgccttccttcccactgcttgtcttcagtgtgcccggctgggcaggggtgcggtggtggtggccgatgaggacaggaaagggagatagccagggcgaggtggggcgagggctccttcccccaagcaacaccgcccagccctgctccaggcccctgcactccgcccacccctaccctggctgcacctgagcttgctgcccctggggatgttgcccagtggctgtgcactgctctgtgcacgtgcgtgtgtgtgagtgcacttgtgtgtgggtgactaagtggatgcatgtgtgtgcctgtgtgagtgagggtatgtgcacctaagtgtgtacatgtgtgtatgttgtgaaagtgtctgtgcacatgaatgtttgtgtgtgtgtgaactctttcttactgctggaagtcacagaattcatattgctgcccgggttggtgtggccacctttccctttgtccaagactccacatggaaggcatttgagctcgacctccgaaaagctaccc

SEQ ID NO: 128245 - DNA, 756 bp, Homo sapiens
  Payload ID: 5110
  Gene Symbol: DUSP23
  Gene Name: dual specificity phosphatase 23
  Uniprot ID: Q9BVJ7
  ENST ID: ENST00000368107
  CDS Start-End: 99-551
gagttacttggctcggagcgggcgaggggacgcgtgggcggagcggggctggccagcctcggcccccatgacccgctgtcctgtgccctttcccagcgatgggcgtgcagccccccaacttctcctgggtgcttccgggccggctggcgggactggcgctgccgcggctccccgcccactaccagttcctgttggacctgggcgtgcggcacctggtgtccctgacggagcgcgggccccctcacagcgacagctgccccggcctcaccctgcaccgcctgcgcatccccgacttctgcccgccggcccccgaccagatcgaccgcttcgtgcagatcgtggacgaggccaacgcacggggagaggctgtgggagtgcactgtgctctgggctttggccgcactggcaccatgctggcctgttacctggtgaaggagcggggcttggctgcaggagatgccattgctgaaatccgacgactacgacccggctccatcgagacctatgagcaggagaaagcagtcttccagttctaccagcgaacgaaataaggggccttagtacccttctaccaggccctcactccccttccccatgttgtcgatggggccagagatgaagggaagtggactaaagtattaaaccctctagctcccattggctgaagacactgaagtagcccacccctgcaggcaggtcctgattgaaggggaggcttgtactgctttgttgaataaatgagttttacgaaccagg

SEQ ID NO: 128246 - DNA, 694 bp, Homo sapiens
  Payload ID: 5110
  Gene Symbol: DUSP23
  Gene Name: dual specificity phosphatase 23
  Uniprot ID: Q9BVJ7
  ENST ID: ENST00000368108
  CDS Start-End: 37-489
gcagaccacgtggcccgggaggcgccgaggccagcgatgggcgtgcagccccccaacttctcctgggtgcttccgggccggctggcgggactggcgctgccgcggctccccgcccactaccagttcctgttggacctgggcgtgcggcacctggtgtccctgacggagcgcgggccccctcacagcgacagctgccccggcctcaccctgcaccgcctgcgcatccccgacttctgcccgccggcccccgaccagatcgaccgcttcgtgcagatcgtggacgaggccaacgcacggggagaggctgtgggagtgcactgtgctctgggctttggccgcactggcaccatgctggcctgttacctggtgaaggagcggggcttggctgcaggagatgccattgctgaaatccgacgactacgacccggctccatcgagacctatgagcaggagaaagcagtcttccagttctaccagcgaacgaaataaggggccttagtacccttctaccaggccctcactccccttccccatgttgtcgatggggccagagatgaagggaagtggactaaagtattaaaccctctagctcccattggctgaagacactgaagtagcccacccctgcaggcaggtcctgattgaaggggaggcttgtactgctttgttgaataaatgagttttacgaaccagg

SEQ ID NO: 128247 - DNA, 729 bp, Homo sapiens
  Payload ID: 5110
  Gene Symbol: DUSP23
  Gene Name: dual specificity phosphatase 23
  Uniprot ID: Q9BVJ7
  ENST ID: ENST00000368109
  CDS Start-End: 72-524
gggcagagcgacccgagggcggcgccctgcagaccacgtggcccgggaggcgccgaggccaggtaggtgcgatgggcgtgcagccccccaacttctcctgggtgcttccgggccggctggcgggactggcgctgccgcggctccccgcccactaccagttcctgttggacctgggcgtgcggcacctggtgtccctgacggagcgcgggccccctcacagcgacagctgccccggcctcaccctgcaccgcctgcgcatccccgacttctgcccgccggcccccgaccagatcgaccgcttcgtgcagatcgtggacgaggccaacgcacggggagaggctgtgggagtgcactgtgctctgggctttggccgcactggcaccatgctggcctgttacctggtgaaggagcggggcttggctgcaggagatgccattgctgaaatccgacgactacgacccggctccatcgagacctatgagcaggagaaagcagtcttccagttctaccagcgaacgaaataaggggccttagtacccttctaccaggccctcactccccttccccatgttgtcgatggggccagagatgaagggaagtggactaaagtattaaaccctctagctcccattggctgaagacactgaagtagcccacccctgcaggcaggtcctgattgaaggggaggcttgtactgctttgttgaataaatgagttttacgaaccagg

SEQ ID NO: 128248 - DNA, 1835 bp, Homo sapiens
  Payload ID: 5111
  Gene Symbol: DUSP26
  Gene Name: dual specificity phosphatase 26 (putative)
  Uniprot ID: Q9BV47
  ENST ID: ENST00000256261
  CDS Start-End: 519-1154
agttaattctgtctgggaggagtgtgtgtgtttaagacagtgcctgggatgacttataatgtaatctttaggcaaaacgctttgtaattggtgcagctctgagaacacacgcatgcattccaggcggtgctgctggggctcggcggggccgtgtctggtctgcaaggcgcgcgggctcgtggggggttggctggggagcccacgctgcctggcgactcgggccaccgaatgtgagaccgagtccctttatgtcaccagcgcacacgctgatttgaaccctgcttcgacgtgtgtgtcatggcttaaaaatagctgctaatctgtcaacctgtcttgggcagaaacagcggcggcgacagcagcaggagcgtcatggccgtggcgctgtctgcgccggcgatccgcctttcggactgaggcccagcgcagcgcttgcaaagagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccaggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgagcatccacttccagacggctgccgacttcatccaccgggcgctgagccagccaggagggaagatcctggtgcattgtgctgtgggcgtgagccgatccgccaccctggtactggcctacctcatgctgtaccaccaccttaccctcgtggaggccatcaagaaagtcaaagaccaccgaggcatcatccccaaccggggcttcctgaggcagctcctggccctggaccgcaggctgcggcagggtctggaagcatgaggggagggggagagaggtcaggccaggcccgtgggtaggtccctggctcccagctggagataggaggcccaggtggcaggtagcaggaggcccagatcacccatcctcccctggggtcaggagaggccgagccccaggccactgtcactctttgtgggaggggacggggagtgaggttgggcagtgtggtggatgggcacccaggaagggttgaccagggaaggaggcagctaggctgtagatggaagatggtcctgggattcgaacaccgctgggatctggccagggtgctccctgggattcacagtcccttcccctctttgtgcccaagtgtttccctctctccctcaccaaaacaaaagggccatctctgccctgcacttgtgcagaaagtcagggatacggcaagcatgaatgcaatggtgtagagttgtgtgaaacccctagcatagagacagacagcgaagagatggtgtgaaaagcttgcagaaccagacagagaaccccacagactttccactccaagcacaggaggaggtagctagcgtgtgagggttggcactaggcccacggctgctgcttgggccaaaaacatacagaggtgcatggctggcagtcttgaaattgtcactcgcttactggatccaagcgtctcgaggataaataaagatcatgaaaaag

SEQ ID NO: 128249 - DNA, 1373 bp, Homo sapiens
  Payload ID: 5111
  Gene Symbol: DUSP26
  Gene Name: dual specificity phosphatase 26 (putative)
  Uniprot ID: Q9BV47
  ENST ID: ENST00000523956
  CDS Start-End: 573-1208
gctgctggggctcggcggggccgtgtctggtctgcaaggcgcgcgggctcgtggggggttggctggggagcccacgctgcctggcgactcgggccaccgaatgtgagaccgagtccctttatgtcaccagcgcacacgctgatttgaaccctgcttcgacgtgtgtgtcatggcttaaaaatagctgctaatctgtcaacctgtcttgggcagaaacagcggcggcgacagcagcaggagcgtcatggccgtggcgctgtctgcgccggcgatccgcctttcggactgaggcccagcgcagcgcttgcaaagagagccaaagagctgagcaaaaggagctgctgcagcttgaagaaaaagccacccctgaaggctcctgccagagccaggcttaccttctctccctcgagaatcttctcccgaaggaccagcccagggaagggaagcagctgctctggactcactcaagtgtgtctcacaccccttcctcttccagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccaggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgagcatccacttccagacggctgccgacttcatccaccgggcgctgagccagccaggagggaagatcctggtgcattgtgctgtgggcgtgagccgatccgccaccctggtactggcctacctcatgctgtaccaccaccttaccctcgtggaggccatcaagaaagtcaaagaccaccgaggcatcatccccaaccggggcttcctgaggcagctcctggccctggaccgcaggctgcggcagggtctggaagcatgaggggagggggagagaggtcaggccaggcccgtgggtaggtccctggctcccagctggagataggaggcccaggtggcaggtagcaggaggcccagatcacccatcctcccctggggtcaggagaggccgagccccaggccactgtcactctttgtgggaggggac

SEQ ID NO: 128250 - DNA, 729 bp, Homo sapiens
  Payload ID: 5111
  Gene Symbol: DUSP26
  Gene Name: dual specificity phosphatase 26 (putative)
  ENST ID: ENST00000522982
  CDS Start-End: 293-729
ggacatgtgactctcccacctcgtttcgtggcagagccaaagagctgagcaaaaggagctgctgcagcttgaagaaaaagccacccctgaaggctcctgccagagccaggcttaccttctctccctcgagaatcttctcccgaaggaccagcccagggaagggaagcagctgctctggactcactcaagtgtgtctcacaccccttcctcttccagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccaggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgagcatccacttccagacggctgccgacttcatccaccgggcgctgagccagccaggagg

SEQ ID NO: 128251 - DNA, 3597 bp, Homo sapiens
  Payload ID: 5112
  Gene Symbol: DUSP27
  Gene Name: dual specificity phosphatase 27 (putative)
  Uniprot ID: Q5VZP5
  ENST ID: ENST00000271385
  CDS Start-End: 121-3597
atgacgcctgagccaaaggccctacctcctgtggccttggttagagacaccgaaggccagctgtgtcttccccagcagagacaaaggtgtgcgcatgggcatagaggttggcaggttgtcatggcgaccagaaaggacacagaggaggagcaggtagtcccaagcgaggaggacgaagccaacgtgagggcggtgcaggcccactacctccgaagcccctcccctagccagtattcgatggtctcagatgcagaaacagaaagcattttcatggaacccattcacctctcctcagccattgcagccaaacagatcatcaatgaagaactcaagccaccgggggtcagagcagacgcagagtgtccaggcatgctggagtctgctgaacagctgctggtggaggacctgtacaaccgcgtcagggagaagatggatgacaccagcctctataatacgccctgtgtcctggacctacagcgggccctggttcaggatcgccaagaggcgccctggaatgaggtggatgaggtctggcccaatgtcttcatagctgagaagagtgtggctgtgaacaaggggaggctgaagaggctgggaatcacccacattctgaatgctgcgcatggcaccggcgtttacactggccccgaattctacactggcctggagatccagtacctgggtgtagaggtggatgactttcctgaggtggacatttcccagcatttccggaaggcgtctgagttcctggatgaggcgctgctgacttacagagggaaagtcctggtcagcagcgaaatgggcatcagccggtcagcagtgctggtggtcgcctacctgatgatcttccacaacatggccatcctggaggctttgatgaccgtgcgtaagaagcgggccatctaccccaatgagggcttcctgaagcagctgcgggagctcaatgagaagttgatggaggagagagaagaggactatggccgggaggggggatcagctgaggctgaggagggcgagggcactgggagcatgctcggggccagagtgcacgccctgacggtggaagaggaggacgacagcgccagccacctgagtggctcctccctggggaaggccacccaggcctccaagcccctcaccctcatagacgaggaggaggaggagaaactgtacgagcagtggaagaaggggcagggcctcctctcagacaaggtcccccaggatggaggtggctggcgctcagcctcctctggccagggtggggaggagctcgaggacgaggacgtggagaggatcatccaggagtggcagagccgaaacgagaggtaccaagcagaagggtaccggaggtggggaagggaggaggagaaggaggaggagagcgacgctggctcctcggtggggaggcggcggcgcaccctgagcgagagcagcgcctgggagagcgtgagcagccacgacatctgggtcctgaagcagcagctggagctgaaccgcccggaccacggcaggaggcgccgcgcagactcgatgtcctcggagagcacctgggacgcatggaacgagaggctgctggagattgagaaggaggcttcccggaggtaccacgccaagagcaagagagaggaggcggcagacaggagctcagaagcagggagcagggtgcgggaggatgatgaggacagcgtgggctctgaggccagttccttctacaacttctgcagcaggaacaaggacaagctcactgccctggaaagatggaagatcaagagaatccaatttggatttcacaagaaagacttgggagcgggagacagcagcggtgagcccggtgcagaggaggcagtaggggagaagaacccctccgacgtcagcctgacagcctaccaggcctggaagctgaaacaccagaagaaggtgggcagtgagaacaaggaggaggtggtggagctcagcaagggggaggactcggccttggctaagaagagacaacggaggctggagctgctggagagaagccggcagacgctggaggagagccagtctatggcaagctgggaggcggacagctccacggccagcgggagcattcccctgtctgcgttctggtctgcagacccctcagtcagcgctgatggggacacgacgtcagtactgagcacccagagccaccgctcccacctgtctcaggctgcaagcaacatagcggggtgttcaacctccaaccccaccacacccctgcctaacctgccagtggggcctggagacaccatttccattgccagtatccagaactggattgccaatgtagtcagtgagacccttgctcagaagcaaaatgaaatgctgctgttgtcccgctcaccgtctgttgcaagcatgaaggcagtaccagcggctagctgcctgggggatgaccaagtctccatgcttagtggacacagcagctcctccttgggtggctgcctgttgcctcagagccaggcaagacccagctctgacatgcagtctgtgctgtcctgcaacaccacactgagctcacccgcggaaagttgcagaagcaaagtgagggggaccagcaagcccatcttcagcctctttgctgacaatgtggacctaaaggaacttggccggaaggagaaggagatgcagatggagcttagggagaagatgtctgagtacaaaatggaaaagctggcctcagacaacaaacgcagctccctcttcaagaagaagaaggtcaaggaagatgaggatgatggtgtgggtgatggggatgaggacactgacagtgccatagggagcttccgatattcttcccgcagtaattcccagaaacctgaaacagacacatgctcctccctggctgtctgtgatcactatgcaagtggcagcagagttggcaaagagatggatagcagtattaataagtggctcagtggcctcaggacggaggaaaaacctcctttccaaagtgactggtctggaagttccagagggaagtacaccagatcgtccctgctcagggagacagagtctaaatcctccagttacaagttttccaaatcccagtcagaggaacaggacacctcctcctaccacgaggcaaatggcaactctgtaagaagcacttcacggttctcatcttcctccaccagggagggcagagagatgcacaagttctccaggtccacgtacaacgagacctcaagttcccgagaggagagcccagagccctacttcttccgccggaccccagagtcctcagaaagggaagagtccccagaaccacagcgcccaaattgggccaggtccagggactgggaagatgtggaagagtcatccaagtcagacttctctgaatttggagccaagaggaagttcacccagagctttatgaggtctgaagaagagggagagaaagagaggacagaaaacagagaagaagggaggtttgcatctggacggcggtcccagtatcggagaagcactgacagggaggaagaggaagaaatggacgatgaagccatcattgctgcttggagacgccggcaagaagaaaccaggaccaagctgcagaaaaggagggaggactga

SEQ ID NO: 128252 - DNA, 4164 bp, Homo sapiens
  Payload ID: 5112
  Gene Symbol: DUSP27
  Gene Name: dual specificity phosphatase 27 (putative)
  Uniprot ID: Q5VZP5
  ENST ID: ENST00000361200
  CDS Start-End: 167-3643
aggtttcctgttaacagctgtcctgcccctaggagaagaagccctgaggaaggaggtggctggttcctgtctcactggccggagcttcagcttcagtcatttcatctgggtccctcagcccttggtggggaacatccaggcaggttagagaggttggcaggttgtcatggcgaccagaaaggacacagaggaggagcaggtagtcccaagcgaggaggacgaagccaacgtgagggcggtgcaggcccactacctccgaagcccctcccctagccagtattcgatggtctcagatgcagaaacagaaagcattttcatggaacccattcacctctcctcagccattgcagccaaacagatcatcaatgaagaactcaagccaccgggggtcagagcagacgcagagtgtccaggcatgctggagtctgctgaacagctgctggtggaggacctgtacaaccgcgtcagggagaagatggatgacaccagcctctataatacgccctgtgtcctggacctacagcgggccctggttcaggatcgccaagaggcgccctggaatgaggtggatgaggtctggcccaatgtcttcatagctgagaagagtgtggctgtgaacaaggggaggctgaagaggctgggaatcacccacattctgaatgctgcgcatggcaccggcgtttacactggccccgaattctacactggcctggagatccagtacctgggtgtagaggtggatgactttcctgaggtggacatttcccagcatttccggaaggcgtctgagttcctggatgaggcgctgctgacttacagagggaaagtcctggtcagcagcgaaatgggcatcagccggtcagcagtgctggtggtcgcctacctgatgatcttccacaacatggccatcctggaggctttgatgaccgtgcgtaagaagcgggccatctaccccaatgagggcttcctgaagcagctgcgggagctcaatgagaagttgatggaggagagagaagaggactatggccgggaggggggatcagctgaggctgaggagggcgagggcactgggagcatgctcggggccagagtgcacgccctgacggtggaagaggaggacgacagcgccagccacctgagtggctcctccctggggaaggccacccaggcctccaagcccctcaccctcatagacgaggaggaggaggagaaactgtacgagcagtggaagaaggggcagggcctcctctcagacaaggtcccccaggatggaggtggctggcgctcagcctcctctggccagggtggggaggagctcgaggacgaggacgtggagaggatcatccaggagtggcagagccgaaacgagaggtaccaagcagaagggtaccggaggtggggaagggaggaggagaaggaggaggagagcgacgctggctcctcggtggggaggcggcggcgcaccctgagcgagagcagcgcctgggagagcgtgagcagccacgacatctgggtcctgaagcagcagctggagctgaaccgcccggaccacggcaggaggcgccgcgcagactcgatgtcctcggagagcacctgggacgcatggaacgagaggctgctggagattgagaaggaggcttcccggaggtaccacgccaagagcaagagagaggaggcggcagacaggagctcagaagcagggagcagggtgcgggaggatgatgaggacagcgtgggctctgaggccagttccttctacaacttctgcagcaggaacaaggacaagctcactgccctggaaagatggaagatcaagagaatccaatttggatttcacaagaaagacttgggagcgggagacagcagcggtgagcccggtgcagaggaggcagtaggggagaagaacccctccgacgtcagcctgacagcctaccaggcctggaagctgaaacaccagaagaaggtgggcagtgagaacaaggaggaggtggtggagctcagcaagggggaggactcggccttggctaagaagagacaacggaggctggagctgctggagagaagccggcagacgctggaggagagccagtctatggcaagctgggaggcggacagctccacggccagcgggagcattcccctgtctgcgttctggtctgcagacccctcagtcagcgctgatggggacacgacgtcagtactgagcacccagagccaccgctcccacctgtctcaggctgcaagcaacatagcggggtgttcaacctccaaccccaccacacccctgcctaacctgccagtggggcctggagacaccatttccattgccagtatccagaactggattgccaatgtagtcagtgagacccttgctcagaagcaaaatgaaatgctgctgttgtcccgctcaccgtctgttgcaagcatgaaggcagtaccagcggctagctgcctgggggatgaccaagtctccatgcttagtggacacagcagctcctccttgggtggctgcctgttgcctcagagccaggcaagacccagctctgacatgcagtctgtgctgtcctgcaacaccacactgagctcacccgcggaaagttgcagaagcaaagtgagggggaccagcaagcccatcttcagcctctttgctgacaatgtggacctaaaggaacttggccggaaggagaaggagatgcagatggagcttagggagaagatgtctgagtacaaaatggaaaagctggcctcagacaacaaacgcagctccctcttcaagaagaagaaggtcaaggaagatgaggatgatggtgtgggtgatggggatgaggacactgacagtgccatagggagcttccgatattcttcccgcagtaattcccagaaacctgaaacagacacatgctcctccctggctgtctgtgatcactatgcaagtggcagcagagttggcaaagagatggatagcagtattaataagtggctcagtggcctcaggacggaggaaaaacctcctttccaaagtgactggtctggaagttccagagggaagtacaccagatcgtccctgctcagggagacagagtctaaatcctccagttacaagttttccaaatcccagtcagaggaacaggacacctcctcctaccacgaggcaaatggcaactctgtaagaagcacttcacggttctcatcttcctccaccagggagggcagagagatgcacaagttctccaggtccacgtacaacgagacctcaagttcccgagaggagagcccagagccctacttcttccgccggaccccagagtcctcagaaagggaagagtccccagaaccacagcgcccaaattgggccaggtccagggactgggaagatgtggaagagtcatccaagtcagacttctctgaatttggagccaagaggaagttcacccagagctttatgaggtctgaagaagagggagagaaagagaggacagaaaacagagaagaagggaggtttgcatctggacggcggtcccagtatcggagaagcactgacagggaggaagaggaagaaatggacgatgaagccatcattgctgcttggagacgccggcaagaagaaaccaggaccaagctgcagaaaaggagggaggactgagctggggaaaatctgagaacactgaaagaaaccactcacgttagcatagggctcagggcacacgttgccaccactcatcgcaggatgaggatacagagaggatcttccagaggggcagagccaaaatgagaggtaccaagcataagggcagcagaggtggagtagggaggaggcaaggagggggagaaccatcaatacgaatacgaggtccgaatgcggaccaactgataccattttctgttgctcagcgccctctaagctttggtgtttcacttaatgtatttggcagtgttcatcacaggctagagaggtgagcttggaaaagcactgtagtttgtcagagactccagtttacatccagaaaggccatgaacataggacacgcttctgtctgtagaggcttcatatgagacccagaaagtctatcctatggcaagtctgacctctcctggcaatgctcagttctgatttttttttttttaatgttttgagtctccattaaaaatggtatgttggcaaat

SEQ ID NO: 128253 - DNA, 4034 bp, Homo sapiens
  Payload ID: 5112
  Gene Symbol: DUSP27
  Gene Name: dual specificity phosphatase 27 (putative)
  Uniprot ID: Q5VZP5
  ENST ID: ENST00000443333
  CDS Start-End: 1-3477
atggcgaccagaaaggacacagaggaggagcaggtagtcccaagcgaggaggacgaagccaacgtgagggcggtgcaggcccactacctccgaagcccctcccctagccagtattcgatggtctcagatgcagaaacagaaagcattttcatggaacccattcacctctcctcagccattgcagccaaacagatcatcaatgaagaactcaagccaccgggggtcagagcagacgcagagtgtccaggcatgctggagtctgctgaacagctgctggtggaggacctgtacaaccgcgtcagggagaagatggatgacaccagcctctataatacgccctgtgtcctggacctacagcgggccctggttcaggatcgccaagaggcgccctggaatgaggtggatgaggtctggcccaatgtcttcatagctgagaagagtgtggctgtgaacaaggggaggctgaagaggctgggaatcacccacattctgaatgctgcgcatggcaccggcgtttacactggccccgaattctacactggcctggagatccagtacctgggtgtagaggtggatgactttcctgaggtggacatttcccagcatttccggaaggcgtctgagttcctggatgaggcgctgctgacttacagagggaaagtcctggtcagcagcgaaatgggcatcagccggtcagcagtgctggtggtcgcctacctgatgatcttccacaacatggccatcctggaggctttgatgaccgtgcgtaagaagcgggccatctaccccaatgagggcttcctgaagcagctgcgggagctcaatgagaagttgatggaggagagagaagaggactatggccgggaggggggatcagctgaggctgaggagggcgagggcactgggagcatgctcggggccagagtgcacgccctgacggtggaagaggaggacgacagcgccagccacctgagtggctcctccctggggaaggccacccaggcctccaagcccctcaccctcatagacgaggaggaggaggagaaactgtacgagcagtggaagaaggggcagggcctcctctcagacaaggtcccccaggatggaggtggctggcgctcagcctcctctggccagggtggggaggagctcgaggacgaggacgtggagaggatcatccaggagtggcagagccgaaacgagaggtaccaagcagaagggtaccggaggtggggaagggaggaggagaaggaggaggagagcgacgctggctcctcggtggggaggcggcggcgcaccctgagcgagagcagcgcctgggagagcgtgagcagccacgacatctgggtcctgaagcagcagctggagctgaaccgcccggaccacggcaggaggcgccgcgcagactcgatgtcctcggagagcacctgggacgcatggaacgagaggctgctggagattgagaaggaggcttcccggaggtaccacgccaagagcaagagagaggaggcggcagacaggagctcagaagcagggagcagggtgcgggaggatgatgaggacagcgtgggctctgaggccagttccttctacaacttctgcagcaggaacaaggacaagctcactgccctggaaagatggaagatcaagagaatccaatttggatttcacaagaaagacttgggagcgggagacagcagcggtgagcccggtgcagaggaggcagtaggggagaagaacccctccgacgtcagcctgacagcctaccaggcctggaagctgaaacaccagaagaaggtgggcagtgagaacaaggaggaggtggtggagctcagcaagggggaggactcggccttggctaagaagagacaacggaggctggagctgctggagagaagccggcagacgctggaggagagccagtctatggcaagctgggaggcggacagctccacggccagcgggagcattcccctgtctgcgttctggtctgcagacccctcagtcagcgctgatggggacacgacgtcagtactgagcacccagagccaccgctcccacctgtctcaggctgcaagcaacatagcggggtgttcaacctccaaccccaccacacccctgcctaacctgccagtggggcctggagacaccatttccattgccagtatccagaactggattgccaatgtagtcagtgagacccttgctcagaagcaaaatgaaatgctgctgttgtcccgctcaccgtctgttgcaagcatgaaggcagtaccagcggctagctgcctgggggatgaccaagtctccatgcttagtggacacagcagctcctccttgggtggctgcctgttgcctcagagccaggcaagacccagctctgacatgcagtctgtgctgtcctgcaacaccacactgagctcacccgcggaaagttgcagaagcaaagtgagggggaccagcaagcccatcttcagcctctttgctgacaatgtggacctaaaggaacttggccggaaggagaaggagatgcagatggagcttagggagaagatgtctgagtacaaaatggaaaagctggcctcagacaacaaacgcagctccctcttcaagaagaagaaggtcaaggaagatgaggatgatggtgtgggtgatggggatgaggacactgacagtgccatagggagcttccgatattcttcccgcagtaattcccagaaacctgaaacagacacatgctcctccctggctgtctgtgatcactatgcaagtggcagcagagttggcaaagagatggatagcagtattaataagtggctcagtggcctcaggacggaggaaaaacctcctttccaaagtgactggtctggaagttccagagggaagtacaccagatcgtccctgctcagggagacagagtctaaatcctccagttacaagttttccaaatcccagtcagaggaacaggacacctcctcctaccacgaggcaaatggcaactctgtaagaagcacttcacggttctcatcttcctccaccagggagggcagagagatgcacaagttctccaggtccacgtacaacgagacctcaagttcccgagaggagagcccagagccctacttcttccgccggaccccagagtcctcagaaagggaagagtccccagaaccacagcgcccaaattgggccaggtccagggactgggaagatgtggaagagtcatccaagtcagacttctctgaatttggagccaagaggaagttcacccagagctttatgaggtctgaagaagagggagagaaagagaggacagaaaacagagaagaagggaggtttgcatctggacggcggtcccagtatcggagaagcactgacagggaggaagaggaagaaatggacgatgaagccatcattgctgcttggagacgccggcaagaagaaaccaggaccaagctgcagaaaaggagggaggactgagctggggaaaatctgagaacactgaaagaaaccactcacgttagcatagggctcagggcacacgttgccaccactcatcgcaggatgaggatacagagaggatcttccagaggggcagagccaaaatgagaggtaccaagcataagggcagcagaggtggagtagggaggaggcaaggagggggagaaccatcaatacgaatacgaggtccgaatgcggaccaactgataccattttctgttgctcagcgccctctaagctttggtgtttcacttaatgtatttggcagtgttcatcacaggctagagaggtgagcttggaaaagcactgtagtttgtcagagactccagtttacatccagaaaggccatgaacataggacacgcttctgtctgtagaggcttcatatgagacccagaaagtctatcctatggcaagtctgacctctcctggcaatgctcagttctgatttttttttttttaatgttttgagtctccattaaaaatggtatgttggcaaatagttcttctttattctggtcatgtttaactttttgg

SEQ ID NO: 128254 - DNA, 1555 bp, Homo sapiens
  Payload ID: 5113
  Gene Symbol: DUSP28
  Gene Name: dual specificity phosphatase 28
  Uniprot ID: Q4G0W2
  ENST ID: ENST00000343217
  CDS Start-End: 632-1162
tggtctatgaagaagtgatgaaaatagaaattagttttattttatgagccatgtgttataatacatagaaaaaaatgcaccaattacaaagcgggccacaaaaaggaataaacgtaaagccgacaacgcagtcactagggaaagggtgaagacacgggaaccacgcagcccgccgtccacgtgcaccgggtagccacggggccctagccgaacgacgcggacgcgaagtgggcgggcccggccaagccacgcctccgcgccagacgccgcagtagagcgggcagggcgctgcgcccaagagccacagacgcaagcccagtgccacaggccgcgggggcggggaggacggcgcccggggacagagaacatgggacgcagagcggtccaaggccccggcgccctggtgaggcccaaacctcccgccatgccccggccccaacgagacccaagccccctgtcccggcccagcgcccgcgggggacccaagccccagcctggtccacctcggaggcctctaggacccgggggcgcccggcggcccgcccggctcccacaaatagactcctgggcgggcgcctgagcccccaaaatagatcctcagggcccaaaagcagactcttcggcgggcgccatgggaccggcagaagctgggcgccgcggggccgcctcgcccgtacctccaccgttggtgcgcgtcgcgccctcactcttcctcgggagcgcgcgagccgcgggcgcggaggagcagctggcgcgcgcgggagtcacgctgtgcgtcaacgtctcccgccagcagcccggcccgcgcgcgcccggcgtggcagagctgcgcgtgcccgtgttcgacgacccggctgaggacctgctggcgcacctggagcccacgtgcgccgccatggaggccgcggtgcgcgccggcggcgcctgcctagtctactgcaagaacggccgcagccgctcggccgccgtctgcaccgcgtacctcatgcggcaccgcggcctcagcctggcgaaggccttccagatggtgaagagcgctcgcccggtagcagaaccgaacccgggcttctggtctcagctccagaagtatgaggaggccctccaggcccagtcctgcctgcagggagagcccccagccttagggttgggccctgaggcttgaagcttgaaggcctgctgcctggaggaaggatgtccctgcactgatacagaagctgtttctggcaaagcctgccgtgtcttacatttgtctctctatccggattagatgttgctatatgaacacatcgggactgtgtctgcaggaaggagctccccattcgaggccttcacagtgtcacccacattcacctctttccacttaaacgtgtcccatgaatcttgtcataacagttttgtgttccttaactattttgtctgccatgtcatttatgatgtatataacctctttaatgcctgaaatcataagaataatcatcaaaggcaagagggttgtatattttcccgttggagacacatctggaatttgctgcaataaaataataataagaaagca

SEQ ID NO: 128255 - DNA, 3461 bp, Homo sapiens
  Payload ID: 5113
  Gene Symbol: DUSP28
  Gene Name: dual specificity phosphatase 28
  Uniprot ID: Q4G0W2
  ENST ID: ENST00000405954
  CDS Start-End: 384-914
acgcctccgcgccagacgccgcagtagagcgggcagggcgctgcgcccaagagccacagacgcaagcccagtgccacaggccgcgggggcggggaggacggcgcccggggacagagaacatgggacgcagagcggtccaaggccccggcgccctggtgaggcccaaacctcccgccatgccccggccccaacgagacccaagccccctgtcccggcccagcgcccgcgggggacccaagccccagcctggtccacctcggaggcctctaggacccgggggcgcccggcggcccgcccggctcccacaaatagactcctgggcgggcgcctgagcccccaaaatagatcctcagggcccaaaagcagactcttcggcgggcgccatgggaccggcagaagctgggcgccgcggggccgcctcgcccgtacctccaccgttggtgcgcgtcgcgccctcactcttcctcgggagcgcgcgagccgcgggcgcggaggagcagctggcgcgcgcgggagtcacgctgtgcgtcaacgtctcccgccagcagcccggcccgcgcgcgcccggcgtggcagagctgcgcgtgcccgtgttcgacgacccggctgaggacctgctggcgcacctggagcccacgtgcgccgccatggaggccgcggtgcgcgccggcggcgcctgcctagtctactgcaagaacggccgcagccgctcggccgccgtctgcaccgcgtacctcatgcggcaccgcggcctcagcctggcgaaggccttccagatggtgaagagcgctcgcccggtagcagaaccgaacccgggcttctggtctcagctccagaagtatgaggaggccctccaggcccagtcctgcctgcagggagagcccccagccttagggttgggccctgaggcttgaagcttgaaggcctgctgcctggaggaaggatgtccctgcactgatacagaaggctggtctttacccttcttcctcactgtcatatcgagttttcctttgtgtgtgtgtgtgtgaaacatagtgcttttaattttatatttccggctgaggtgatgcacaaattatcttacagacacaaaaagaaatacatttggtaaaacatcgaagacaaattaagaaaaagcaaatagggatcctccattatttacactccagaatcttgagtgtttgggggtgccggcgcattctaccagtctcagggaaggacatgagtacagactacagtaatcagaatctgagtcataggtgaaatcaggaaaagcaactcttcttgtgtttatttttagtagtgtcataagaacggactagttcttcctgcgtgaccacggatgcttctgtttgagaaaatgcatacccacgtgggacatttagatcaagaaagctgttgatgaagacattgttgaagggcaacttgggtgattggggaattattctcttcatcagcccctctgcaatacagctggagctgtcccataggagttcggacaattacggacatcctttttctttctctctttctttttttttgtttgtttgtttgagacagagtctctgttgcccaggctggagtgcagtggcgcaatcccggctcactgcaacctccgcctccctggttcaagtgattctcctgcctcagcctcctgagtagctgggactacaggtgtgtgacaccagacccggctaattttttgtatttttagtagagatggggggtttcaccatgttagccaggatggtctcaaactcctgacctcgtgatccacccacctcagcctcccaaagtgctgggattacaggcgtgagccaccgtgcccagcctcctttttctattactagagaactccaggacattaagaatttcaaaagtgattttttcacccatggcttctacggtgacagagtatggtgttcctgtagggaaacaaagccaagtttttttgctcctttcactaaagctgcttcatccggggaggaagcctggtagattataatatttccagggataacagtgtggcacacagataacagggtaagaaattggtctatatagttttctgtgggatggccattctcaatgttctccaataaactggggtaattaaaatatcagggctcggatggaaggtgttgcaccataaatgacacctgcagtggtacttgttaaatgtcttaacattgcaagtgagggttcccattttatcagaaaatagaaattttacctgcccaagttcttcactgagattgaatgtgctggccatggtgtggacactatttactttataatgcacatcttgatcccagtttataaactgggcctgaatatatttcacaatttccatagtgaccagcagactaatggggatgaggtactgttataagatgatgaacaccagtatgtcaaacacaatgctgtgagctggaatcctctttcaggtaccaaatgtcaccatactttttattccatagcacggctcccacgcagctcactacagacatgaccagagcagcaggaaccaaagggagacccgcccattgtcactttcttaatctctgatctcttgaggtgatttgacagaattctgcaggaatttggtttcaaagccagtgtaaacaactatgccagtgatccactgagcatttcttttttttttttcttgagacggagtctcactctggtgcccaggctggagtgggcgccatcttggctcactgcaagctccgcctcccggcttcatgccattctcgtccttcagcctcctgagtggctgggattacaggcgcccgccaccacgcctagctaatttctttgtatttttggtagagacggggtttcactgtgttagccaggatggtctcaatctcctgacctcatgatcctcccgcctcggcctcccaaagcgctgggattacaggcgtgagccacctcgcccggccaatccactgagcatttctaagctgtgtatctcttaacaagacccagtcaggccctattggaacagggcttttaccacctaggcggaagctcagccattgaaatgacgatcaggtgcttcacggtctatttttccagataggcctaacagctggttttctgtttgcatttcagctgtttctggcaaagcctgccgtgtcttacatttgtctctctatccggattagatgttgctatatgaacacatcgggactgtgtctgcaggaaggagctccccattcgaggccttcacagtgtcacccacattcacctctttccacttaaacgtgtcccatgaatcttgtcataacagttttgtgttccttaactattttgtctgccatgtcatttatgatgtatataacctctttaatgcctgaaatcataagaataatcatcaaaggcaagagggttgtatattttcccgttggagacacatctggaatttgctgcaataaaataataataagaaagca

SEQ ID NO: 128256 - DNA, 817 bp, Homo sapiens
  Payload ID: 5113
  Gene Symbol: DUSP28
  Gene Name: dual specificity phosphatase 28
  ENST ID: ENST00000438823
  CDS Start-End: 1-424
ggaggagcagctggcgcgcgcgggagtcacgctgtgcgtcaacgtctcccgccagcagcccggcccgcgcgcgcccggcgtggcagagctgcgcgtgcccgtgttcgacgacccggctgaggacctgctggcgcacctggagcccacgtgcgccgccatggaggccgcggtgcgcgccggcggcgcctgcctagtctactgcaagaacggccgcagccgctcggccgccgtctgcaccgcgtacctcatgcggcaccgcggcctcagcctggcgaaggccttccagatggtgaagagcgctcgcccggtagcagaaccgaacccgggcttctggtctcagctccagaagtatgaggaggccctccaggcccagtcctgcctgcagggagagcccccagccttagggttgggccctgaggcttgaagcttgaaggcctgctgcctggaggaaggatgtccctgcactgatacagaagctgtttctggcaaagcctgccgtgtcttacatttgtctctctatccggattagatgttgctatatgaacacatcgggactgtgtctgcaggaaggagctccccattcgaggccttcacagtgtcacccacattcacctctttccacttaaacgtgtcccatgaatcttgtcataacagttttgtgttccttaactattttgtctgccatgtcatttatgatgtatataacctctttaatgcctgaaatcataagaataatcatcaaaggcaagagggttgtatattttcccgttggagacacatctggaatttgctgcaataaaataataataagaaagca

SEQ ID NO: 128257 - DNA, 4110 bp, Homo sapiens
  Payload ID: 5114
  Gene Symbol: DUSP3
  Gene Name: dual specificity phosphatase 3
  Uniprot ID: P51452
  ENST ID: ENST00000226004
  CDS Start-End: 65-622
ccagctgatccgccgctctccgcctcgcttgctcctgccgggcgtgcagggccccgccgccgccatgtcgggctcgttcgagctctcggtgcaggatctcaacgacctgctctcggacggcagcggctgctacagcctcccgagccagccctgcaacgaggtcaccccgcggatctacgtgggcaacgcgtctgtggctcaggacatccccaagctgcagaaactaggcatcacccatgtgctgaacgcggctgagggcaggtccttcatgcacgtcaacaccaatgccaacttctacaaggactccggcatcacatacctgggcatcaaggccaacgacacacaggagttcaacctcagcgcttactttgaaagggctgccgacttcattgaccaggctttggctcaaaagaatggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccacctctgctcgagaggtccgtgggggaggccgtgggcaaaggtgtcccgagctgccatgtttaggaaacacactgtaccctgctcccagcatcacaaggcacttgtctacaagtgtgtcccaacacagtcctgggccactttccccaccctggggagcacataaagaagcttgccaaggggggcgtccttgctccccagttgtcctgtttctgtaacttatgatgtcttttccctgagatgggggctcagagggggaaggcctgtggcctgcatgcttcccgatggcccacggcaggaggtgtgtggaagtgtaaggcctaagatgctcacagaggtccctcatgacctcccttccccaactcccgaatcctctcttgagtgtggacctcaacaccttgagccctagtaaaggaactatgcaaatgcaggccactctccccaccacgtctgtgccctgcactgtccccacagccttccacaccctgtgcataggcagccctctcacgtcttgaggtccgaagctggggtgggggtgtccgtcagttattagtggatggagattcccacagcaaggctgcatttgaatgatttccttaggatgaatggtccctacacaaagaggccttgtgggcaaacctggagaaccctcctaaatccatagagttttcaaaatgtgaatctttggaagccttgagttcagaatctgctgctctggaatatttcccttcgatcttatctcagtcacttcgtttttgagaagagtgatgccttgggcatgcttttttttttttcttttttagaaaacagggagttgaagtccaacctatttaaaaaccccaccatttggagaattacaagggttttgtcctgaattgtagtgttggcaagcccaagccactcgtgctaactgctttttgtctcggttgctattccaagaacagaaggaggaagttggccaattacagcgtgtgtgcatggatgtgtgtggggggcgtgcctctcagaaacgcggccagaagacaagcagggaagtgaaaggtcccaggcacacaccctgcccattgcaggtggctcttacagctctctggtgccagcacgggatccctgaagtgactcagccaggcagacatgagacatggcggagtgtccaaatggatcctttattggtggtagagcaaaaaaacccaaacacgataaacctttcaaaagactttctaaggatgatattggaatgcaccagccctcacatgtgtatgcacatttgccagaatataagagttttgttttaaatacagtcttgttaggattttacgttattgttattatggaaagtgattgtgatgctatttatcttcagggtcactctgggcaaagagaaggtcctcagccatgcccccagcaccttgcacataggtgtctgataaaagtttaagaaagtaaacactttttgagcaccaaatatatatagggcattgttctggtgggtgtgtcacgctcccagaagactgaattcatggtaggatcactcgcaaggccttgtgaaggagtcttacctaaaacgaaagaaatatcagggacttttgttgactatttacaactcagttttacatttaaattcaggcagtgttaatatgccaaggtagggaatgtgcctttttcagagttggccaggagctcctggctgggacacggagaggcaggtgtggcgtaaggcctcactcccggctgggaaggtctctgatcacacagaagcagccctgcccagcctggtcatttgctgtccgcttttctctgtgaccacagcagccctgaacaaccagtatgtgtcttcttctccagatagtgaaaaaggtgtccagataaacccacctaagtgaaatggccatcctctaaactgggtacctcactgcacagcttctaggtagccttccaacttaatctaacttgagcctcacagtaaccctgtaaagttagtagagcttgttcttgtattgtgaccttttttaaaaaaaaggaactgaggttcagaatgattaagggcctggcccccagggttgtccagctccataaggtggagctgggcaagattttgggtttgctgctccctgaagctggattctttcatacgatactctttctcaagaagggggctccctgggatctccaggtgtactgcacttaccctcaatccagccccggagaagcaagtgaaaagggtgggtccctcataggctagaatgtgcagctctttctccaggtgggatgtagcaccccgaagtagagctttctgctctgctcctggaaaaggctagggagctggggctggggctcccctcccatgaccaggcagtggtcaccccatgggacaggcacagctacttacgcgaacacagcaggttggtgtggctggctaactaggacctctcgaaagtctctgtgggggcatgagggagaaaaggccattgggagaattactgcctttactttgggactacttttatgctgataacttgggatttcttgatagtccttcacccctgaaaccccgtatttacttaacaagatttagctcttagttcttcaagtaaaattaaagtctcttgtgtaagagccaacacatgcccagctgcggatgggagctgttcctggacagccttctactgcctgggaagtgatggaacaggaactcagggtgcccttaccccctccccagacctgttccctttctttgactgacagagcaccatccaggcaaaattagagcgccaaatggttttcttctcaatcttaaagcagtatacctttccacaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatgggtatgtgagccataatatgatgggcagcaggtggcgctgccttccacccatggtgatggatggtttggaaagggaatgttggtgccttttgtgccacaagttaagatgctactgttttaaaggaaaaaaaaaaaaaaaagtactgatcttcaatatgaagacatgagcttttctcgcaggaaattttctttttcacagaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaggta

SEQ ID NO: 128258 - DNA, 1019 bp, Homo sapiens
  Payload ID: 5114
  Gene Symbol: DUSP3
  Gene Name: dual specificity phosphatase 3
  ENST ID: ENST00000590753
  CDS Start-End: 1-338
gcgcttactttgaaagggctgccgacttcattgaccaggctttggctcaaaagaatgatggagtttcactcttgttgcccaggctgaagagcaatggcgcgatcttggctcaccgcaacctccacctcccaggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccacctctgctcgagaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatgggtatgtgagccataatatgatgggcagcaggtggcgctgccttccacccatggtgatggatggtttggaaagggaatgttggtgccttttgtgccacaagttaagatgctactgttttaaaggaaaaaaaaaaaaaaaagtactgatcttcaatatgaagacatgagcttttctcgcaggaaattttctttttcacagaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacat

SEQ ID NO: 128259 - DNA, 2077 bp, Homo sapiens
  Payload ID: 5114
  Gene Symbol: DUSP3
  Gene Name: dual specificity phosphatase 3
  ENST ID: ENST00000590342
  CDS Start-End: 12-149
ccgccgccgccatgtcgggctcgttcgagctctcggtgcaggatctcaacgacctgctctcggacggcagcggctgctacagcctcccgagccagccctgcaacgaggtcaccccgcggatctacgtgggcaacgctaagaatgtctaatcagcaggaaagaaccagtgttaacattctgagatgtgaaataggagcctcaagaaagaatatattagcatgcctgtacagccttggaaagcctcaagttggattttcacgatactctgaggacccagttaccaaaatcctaagcttcatggctcagcccaaggatggcatgttgaaaactcaaaactaaccctcctcccattttacagaggaggaaatggtggctcagagtgtgtgagggactacaaggacagggtcaatgtcttgttcatgtctgtggctcaggacatccccaagctgcagaaactaggcatcacccatgtgctgaacgcggctgagggcaggtccttcatgcacgtcaacaccaatgccaacttctacaaggactccggcatcacatacctgggcatcaaggccaacgacacacaggagttcaacctcagcgcttactttgaaagggctgccgacttcattgaccaggctttggctcaaaagaatggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccacctctgctcgagaggtccgtgggggaggccgtgggcaaaggtgtcccgagctgccatgtttaggaaacacactgtaccctgctcccagcatcacaaggcacttgtctacaagtgtgtcccaacacagtcctgggccactttccccaccctggggagcacataaagaagcttgccaaggggggcgtccttgctccccagttgtcctgtttctgtaacttatgatgtcttttccctgagatgggggctcagagggggaaggcctgtggcctgcatgcttcccgatggcccacggcaggaggtgtgtggaagtgtaaggcctaagatgctcacagaggtccctcatgacctcccttccccaactcccgaatcctctcttgagtgtggacctcaacaccttgagccctagtaaaggaactatgcaaatgcaggccactctccccaccacgtctgtgccctgcactgtccccacagccttccacaccctgtgcataggcagccctctcacgtcttgaggtccgaagctggggtgggggtgtccgtcagttattagtggatggagattcccacagcaaggctgcatttgaatgatttccttaggatgaatggtccctacacaaagaggccttgtgggcaaacctggagaaccctcctaaatccatagagttttcaaaatgtgaatctttggaagccttgagttcagaatctgctgctctggaatatttcccttcgatcttatctcagtcacttcgtttttgagaagagtgatgccttgggcatgcttttttttttttcttttttagaaaacagggagttgaagtccaacctatttaaaaaccccaccatttggagaattacaagggttttgtcctgaattgtagtgttggcaagcccaagccactcgtgctaactgctttttgtctcggttgctattccaagaacagaaggaggaagttggccaattacagcgtgtgtgcatggatgtgtgtggggggcgtgcctctcagaaacgcggccagaagacaagcagggaagtgaaaggtcccaggcacacaccctgcccattgcaggtggctcttacagctctctggtgccagcacgggatccctgaagtgactcagccaggcagacatgagacatggcggagtgtccaaatggatcctttattggtggtagagcaaaaaaacccaaacacgataaacctttcaaaaga

SEQ ID NO: 128260 - DNA, 3666 bp, Homo sapiens
  Payload ID: 5114
  Gene Symbol: DUSP3
  Gene Name: dual specificity phosphatase 3
  ENST ID: ENST00000590935
  CDS Start-End: 1-397
gtctgtggctcaggacatccccaagctgcagaaactaggcatcacccatgtgctgaacgcggctgagggcaggtccttcatgcacgtcaacaccaatgccaacttctacaaggactccggcatcacatacctgggcatcaaggccaacgacacacaggagttcaacctcagcgcttactttgaaagggctgccgacttcattgaccaggctttggctcaaaagaatgatggagtttcactcttgttgcccaggctgaagagcaatggcgcgatcttggctcaccgcaacctccacctcccaggttcaagcgattctcctgcctcagcctcccgcctcagcctcccaagtagctgggattacaggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccacctctgctcgagaggtccgtgggggaggccgtgggcaaaggtgtcccgagctgccatgtttaggaaacacactgtaccctgctcccagcatcacaaggcacttgtctacaagtgtgtcccaacacagtcctgggccactttccccaccctggggagcacataaagaagcttgccaaggggggcgtccttgctccccagttgtcctgtttctgtaacttatgatgtcttttccctgagatgggggctcagagggggaaggcctgtggcctgcatgcttcccgatggcccacggcaggaggtgtgtggaagtgtaaggcctaagatgctcacagaggtccctcatgacctcccttccccaactcccgaatcctctcttgagtgtggacctcaacaccttgagccctagtaaaggaactatgcaaatgcaggccactctccccaccacgtctgtgccctgcactgtccccacagccttccacaccctgtgcataggcagccctctcacgtcttgaggtccgaagctggggtgggggtgtccgtcagttattagtggatggagattcccacagcaaggctgcatttgaatgatttccttaggatgaatggtccctacacaaagaggccttgtgggcaaacctggagaaccctcctaaatccatagagttttcaaaatgtgaatctttggaagccttgagttcagaatctgctgctctggaatatttcccttcgatcttatctcagtcacttcgtttttgagaagagtgatgccttgggcatgcttttttttttttcttttttagaaaacagggagttgaagtccaacctatttaaaaaccccaccatttggagaattacaagggttttgtcctgaattgtagtgttggcaagcccaagccactcgtgctaactgctttttgtctcggttgctattccaagaacagaaggaggaagttggccaattacagcgtgtgtgcatggatgtgtgtggggggcgtgcctctcagaaacgcggccagaagacaagcagggaagtgaaaggtcccaggcacacaccctgcccattgcaggtggctcttacagctctctggtgccagcacgggatccctgaagtgactcagccaggcagacatgagacatggcggagtgtccaaatggatcctttattggtggtagagcaaaaaaacccaaacacgataaacctttcaaaagactttctaaggatgatattggaatgcaccagccctcacatgtgtatgcacatttgccagaatataagagttttgttttaaatacagtcttgttaggattttacgttattgttattatggaaagtgattgtgatgctatttatcttcagggtcactctgggcaaagagaaggtcctcagccatgcccccagcaccttgcacataggtgtctgataaaagtttaagaaagtaaacactttttgagcaccaaatatatatagggcattgttctggtgggtgtgtcacgctcccagaagactgaattcatggtaggatcactcgcaaggccttgtgaaggagtcttacctaaaacgaaagaaatatcagggacttttgttgactatttacaactcagttttacatttaaattcaggcagtgttaatatgccaaggtagggaatgtgcctttttcagagttggccaggagctcctggctgggacacggagaggcaggtgtggcgtaaggcctcactcccggctgggaaggtctctgatcacacagaagcagccctgcccagcctggtcatttgctgtccgcttttctctgtgaccacagcagccctgaacaaccagtatgtgtcttcttctccagatagtgaaaaaggtgtccagataaacccacctaagtgaaatggccatcctctaaactgggtacctcactgcacagcttctaggtagccttccaacttaatctaacttgagcctcacagtaaccctgtaaagttagtagagcttgttcttgtattgtgaccttttttaaaaaaaaggaactgaggttcagaatgattaagggcctggcccccagggttgtccagctccataaggtggagctgggcaagattttgggtttgctgctccctgaagctggattctttcatacgatactctttctcaagaagggggctccctgggatctccaggtgtactgcacttaccctcaatccagccccggagaagcaagtgaaaagggtgggtccctcataggctagaatgtgcagctctttctccaggtgggatgtagcaccccgaagtagagctttctgctctgctcctggaaaaggctagggagctggggctggggctcccctcccatgaccaggcagtggtcaccccatgggacaggcacagctacttacgcgaacacagcaggttggtgtggctggctaactaggacctctcgaaagtctctgtgggggcatgagggagaaaaggccattgggagaattactgcctttactttgggactacttttatgctgataacttgggatttcttgatagtccttcacccctgaaaccccgtatttacttaacaagatttagctcttagttcttcaagtaaaattaaagtctcttgtgtaagagccaacacatgcccagctgcggatgggagctgttcctggacagccttctactgcctgggaagtgatggaacaggaactcagggtgcccttaccccctccccagacctgttccctttctttgactgacagagcaccatccaggcaaaattagagcgccaaatggttttcttctcaatcttaaagcagtatacctttccacaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatgggtatgtgagccataatatgatgggcagcaggtggcgctgccttccacccatggtgatggatggtttggaaagggaatgttggtgccttttgtgccacaagttaagatgctactgttttaaagg

SEQ ID NO: 128261 - DNA, 5537 bp, Homo sapiens
  Payload ID: 5115
  Gene Symbol: DUSP4
  Gene Name: dual specificity phosphatase 4
  Uniprot ID: Q13115
  ENST ID: ENST00000240100
  CDS Start-End: 391-1575
gctgagcgccggaggagcgtaggcagggcagcgctggcgccagtggcgacaggagccgcgcgaccggcaaaaatacacgggaggccgtcgccgaaaagagtccgcggtcctctctcgtaaacacactctcctccaccggcgcctccccctccgctctgcgcgccgcccggctgggcgcccgaggccgctccgactgctatgtgaccgcgaggctgcgggaggaaggggacagggaagaagaggctctcccgcgggagcccttgaggaccaagtttgcggccacttctgcaggcgtcccttcttagctctcgcccgcccctttctgcagcctaggcggcccgggttctcttctcttcctcgcgcgcccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagtgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtttgttgccactgagaagcaggcgggttgggtgggaggaggaagaaagggaagaattaggtttgaattgctttttaaaaaaaaaagaaaagaaaaagacagcatctcactatgttgccaaggctcatcttgagaagcaggcgggttgggtgggaggaggaagaaagggaagaattaggtttgaattgcttttttaaaaaaaaagaaaagaaaaaaaaagacagcatctcactatgttgccaaggctcatctcaagctcttgggctcaagagatcctcccacctcggcctcctgagtagctgggactgcaggtgtgtgtcatcatgaccaatgtgaattgcttttgaagctggttcatgggcatgtaggccaccgaagcaattttagaccacagtaagtcaagcttttttccctccgatgatcactgggtggttgcagcattttttgcataaacctgcctaagacttgtctatcgtctgtgatcaatatgccatattacactaaggtgctcctggaaaattgggtgcagttcaaattttcctacagcaaatcatttggcaaggccagccattggggaaaccagacaactagagataaccctgaaatgaatccttttgtaaattgaagcaccatcttttctttttttgcataaattggaggttttaattttagggcagttacctgaagtgaaatataccaacaatttcttgtgttctttaaattcctagttaggtgaatatttttgaaggtcctcttttgaataaagaggggaatggacaccacatttcaggtcttctcgaagtgtggaagggcaagagagcatcagtgagctgatggtggattgcttacatcggattccattggtatgaatttcccaaactggaaatcaaagcgccagggtggggttggggctgactgctggtgagggggctggccgctggctcccgtgacgtgcgtcatgggcacgcaggcgccattttgaatctatcgtcggcacgtgggtgccattttgaatccttagttgggcctttctaaatggagaatggctttggagggagacacgttttctgtggggagggtttgggggggagggaggagggaacaagctacatgctattttgtttgtagtattgtggaacagtcttgttatggagtgccagcttagaggttgttgcaaacttgtctagaagtgagagcatggttttttttagccctttgagagtctacatctaatgaacattcttgctcacccataaataacgtcaagcctcaatgtcaccgtcacgttgggatactctttctcatctggcatcctagacaggacaaggttggttacctttccttccatgaaccatgaacctgtgacggcatcattcatcctgacttcaccaagctccgcctgtgggtgaggccagagctcccactggcaatttttagaagagccagaggctccctgcttcctctagaaataacagttcagggtgaagcatggagggtttcagttcccagacaatggaaccatttagagacaacacagttggacatttccactttttccttgattcctggaagtccagtgggttctgcagctgaaaaagccctgggtcccagcagcagagagacaggacagaggggatgcttgggcggggagggacggtaacctgcagaacagattccatttttatagaacgagtacacgtttgctaaaacagtcctgctttcccagactggattcccaccacagggacagtcggaactcaggactagctccagcgacatctttcctccgaattcaagccttctatcacaatgtcaaaacagctatttataaagccattttcattgtacttgataacagcacgagtcccaaaacttttagaaataaaataggacattggcttgattgaaaagagggactttttaaaaattgttctttcgtcagaagccttttggatgacttacaatagctctgatgaagataccaccccagcgtcagtccaataggtcagtgagtttcaacaggcatccatccctcccatgaagggattctggtgatgggaagtttctgtaatgacaggaaagcattgaccctcattgattgtcaactttggtattagccatgaaagacaggatgctcattgggtgttctgtagagtgaggaatgctgcctattccctcccagaacgtctgacccaggggtgtgtgttgaggagccctgggggaaatggaccaagttttcccacagagcagtattaggctgaagagcaggtgactggtaggccccagctcccatcattccctcccaaagccattttgttcagttgctcatccacgctggattccagagagttttccaatttgggaagccatgagaaaggtttttaaatcttgggaagatggagagagggacataggatagttgactccaacatgacaggaagaggctggagattgggaattggccatcaaccaagcctgtagtagtaaagccatggtcccgcattggaattacttggggaacttatacagttctgatacccaggctctcctagaccagttcaaccaattctaggtgggggactcaggcatcagtgtgtttcgtagctccccgggtgttttccctgtgcagccgagcttgggaaactgccatgctttttggatgtcaaggcgctgttggaggctgggtgtgacagcacagagccaggttgtcttgtggaaaccacagccacgggtttgccactggctcagcatggcctcactgccagtcccagcctggctgagggacaagatggtttctcttgggagttcctgagtggagcacccttccaggctttttgaaagccagctgatctgtggagccttgttaagggactcaatacggtgtttggatattgatgtttttccttgagactgtcttgtccatcaataaagatggaggatgtctcctctttgaaccccgcttccccaccagtactctctctcccttagagtttatgagttattcaaggaggagacttcttaaagacagcaacgcaattcttgtaacttgtgtaaatagccccatctttcagagtgataccatttctacatttgataatgcctgtattcctgtaggatgtatatagtttaggggattttttttttgtttggttttgttttttagaagtcaatatgtctggttttatttattgcttgaaaaagatcatttgaaaaaaataaatacattttcaacca

SEQ ID NO: 128262 - DNA, 2959 bp, Homo sapiens
  Payload ID: 5115
  Gene Symbol: DUSP4
  Gene Name: dual specificity phosphatase 4
  Uniprot ID: Q13115
  ENST ID: ENST00000240101
  CDS Start-End: 1561-2472
gcagttcagacccccccacacccatcaaagagccgctcctcccccccgcaggcgccttcgccgcctccctcccttcctttcctttccgctcctcttccgacctgtccacccgggaggaagggagctggaaagggggcggaaacctctcccctccaaaaagcacaacaaaactgttcagtgcggaggagccgggttcgcccctgccggacagcggggggctttgttccccgcagttgtttcctgcccatttgacctgtcagctgctggggaaacgctgctgttgacctttggttgaactgctaaggcgattttgctgatttttctttctttttccgcgagggctgtcttttgctcctccaaatgagcccagtccccctcccttctccccaaagcgctccaagagaaagtgccaggaaggggcttgtcccggaaggcctggcggctgagcggggccaggtcctggttaggccaccagggtgggcgtccgcgccattgtttgagcttgtcggcgctggtgggagagatgagggcaattcctctgggacgcaagtcccctcgaatggccggggctggccgggatgttccccgcacggcgctgccctcgagtccccccgatggagagcgcgggcgcgccttccttcgctggcgtccaaacccgggaccagctagaacacagcagggctgggactgggttccagccccacgtggagtctggatttgttttgttgtgttttgctttccttcctggaagaaatcccgaggggaccgccctagagcggcagctccaggacctcggcccttgggcttccgggggtgcagccacttaggccccgctcccggggagagagggattattttttaagatttatccccagggcgcgcggcatttccctgtccctcgtgaatcccgttgagagtcctccctccccaacctcctccatttccccagccagaccgattcgagagccctggagattctgggcgaggctagtgactgggtagtacaggcctctagccccaccattgctctctctgtcttcagttccccaggagggcaatggcatcaaacagcacagctctgggggatgtcaatattgcataccttttctacctaaagggaaaatgactcgcttttctgcttgcaaatatggtagtttctgcttacaaatgtaatacaatgcccatgacagccaaggactggaagcataagttgctaggtcttacaggtgattttttacaatgaagcaaactcactatgttagacaccatttacattggatgtctccaactaacaaaagtaactaaagacagatgtaggtgtaaattgagagtgaaatttgaccctttagaccgtcacaacttccttgggcttatcctgggtgcttataggagaggtgggctccacccacaaaaatggactgctcagaaaaatgagggagagagaaagggtggccactttcccgagccaagaaattccttgaaaaaaaatcagaacatctgaaaccagagagccgatttccttaccgggaggcagttcctggctaacgaagaggaagcacgatgggaagaaaagttcactccaacggaagccagtttgctgaacatagcagatcgcccaggaggactgggagagactgcaaaccagttcgagcccccagcatggcgttaggtgtcagccagctggcaggaaggtccaggtgtctgtgttcagagtctcaaggcggctatgagaggttttcctccgagtacccagaattctgttctaaaaccaaggccctggcagccatcccacccccggttccccccagtgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaa

SEQ ID NO: 128263 - DNA, 2557 bp, Homo sapiens
  Payload ID: 5116
  Gene Symbol: DUSP5
  Gene Name: dual specificity phosphatase 5
  Uniprot ID: Q16690
  ENST ID: ENST00000369583
  CDS Start-End: 285-1439
cttatatgggcagccgcgtcacggacggcactcattcacataaaacgctgcgcggccggcggaatccccggcttctagggcggcgagcggccgggctggctatcgagcgagcggggcgggaacgcggagttgcgccgccgctcgggcgccgggctccgtcgcggccgcagccccgcgggtcgccctcccgtgcctcgcccgcggacaccctggccgtggacaccctggccgtgggcacccgcggggcgcgcggcgcggggccgctggccggcggcggcggcggcatgaaggtcacgtcgctcgacgggcgccagctgcgcaagatgctccgcaaggaggcggcggcgcgctgcgtggtgctcgactgccggccctatctggccttcgctgcctcgaacgtgcgcggctcgctcaacgtcaacctcaactcggtggtgctgcggcgggcccggggcggcgcggtgtcggcgcgctacgtgctgcccgacgaggcggcgcgcgcgcggctcctgcaggagggcggcggcggcgtcgcggccgtggtggtgctggaccagggcagccgccactggcagaagctgcgagaggagagcgccgcgcgtgtcgtcctcacctcgctactcgcttgcctacccgccggcccgcgggtctacttcctcaaagggggatatgagactttctactcggaatatcctgagtgttgcgtggatgtaaaacccatttcacaagagaagattgagagtgagagagccctcatcagccagtgtggaaaaccagtggtaaatgtcagctacaggccagcttatgaccagggtggcccagttgaaatccttcccttcctctaccttggaagtgcctaccatgcatccaagtgcgagttcctcgccaacctgcacatcacagccctgctgaatgtctcccgacggacctccgaggcctgcgcgacccacctacactacaaatggatccctgtggaagacagccacacggctgacattagctcccactttcaagaagcaatagacttcattgactgtgtcagggaaaagggaggcaaggtcctggtccactgtgaggctgggatctcccgttcacccaccatctgcatggcttaccttatgaagaccaagcagttccgcctgaaggaggccttcgattacatcaagcagaggaggagcatggtctcgcccaactttggcttcatgggccagctcctgcagtacgaatctgagatcctgccctccacgcccaacccccagcctccctcctgccaaggggaggcagcaggctcttcactgataggccatttgcagacactgagccctgacatgcagggtgcctactgcacattccctgcctcggtgctggcaccggtgcctacccactcaacagtctcagagctcagcagaagccctgtggcaacggccacatcctgctaaaactgggatggaggaatcggcccagccccaagagcaactgtgatttttgtttttaagactcatggacatttcatacctgtgcaatactgaagacctcattctgtcatgctgccccagtgagatagtgagtggtcaccaggcttgcaaatgaacttcagacggacctcagggtaggttctcgggactgaaggaaggccaagccattacgggagcacagcatgtgctgactactgtacttccagacccctgccctcttgggactgcccagtccttgcacctcagagttcgccttttcatttcaagcataaggcaataaatacctgcagcaacgtgggagaaagaagttgctggaccaggagaaaaggcagttatgaagccaattcattttgaaggaagcacaatttccaccttattttttgaactttggcagtttcaatgtctgtctctgttgcttcggggcataagctgatcaccgtctagttgggaaagtaaccctacagggtttgtagggacatgatcagcatcctgatttgaaccctgaaatgttgtgtagacaccctcttgggtccaatgaggtagttggttgaagtagcaagatgttggcttttctggattttttttgccatgggttcttcactgaccttggactttggcatgattcttagtcatacttgaacttgtctcattccacctcttctcagagcaactcttcctttgggaaaagagttcttcagatcatagaccaaaaaagtcataccttcgaggtggtagcagtagattccaggaggagaagggtacttgctaggtatcctgggtcagtggcggtgcaaactggtttcctcagctgcctgtccttctgtgtgcttatgtctcttgtgacaattgttttcctccctgcccctggaggttgtcttcaagctgtggacttctgggatttgcagattttgcaacgtggtactactttttttttctttttgtctgttagttatttctccaggggaaaaggcaataattttctaagacccgtgtgaatgtgaagaaaagcagtatgttactggttgttgttgttgttcttgttttttatagtgtaaaataaaaatagtaaaaggagaaaagca

SEQ ID NO: 128264 - DNA, 4400 bp, Homo sapiens
  Payload ID: 5117
  Gene Symbol: DUSP6
  Gene Name: dual specificity phosphatase 6
  Uniprot ID: Q16828
  ENST ID: ENST00000279488
  CDS Start-End: 1233-2378
tttgtttctgcactctacattgttttaatgaaaataaaatgttattttaagaaaaaaggttttcttctgattttctgcacaaccagacgtttgtttgtttgctttaaaatgtttcaacaaaatcctggtttgtttcgaaatatgttggattagcatttaacacctcatcggtcactaaagcccagtcagttcaccagccccaacacagcctcggctaaaagaacatcagagcaaacagagctgggcctttaaaagtggcaaacaaatgccacacaccgcctaaagaaggggggttgggggaggggagggttaaggcgaacttgggtccaaatgagtttgaagggaatacaaagaacgaaaagtcagcacaagttttcctaaagctagctcgcgaacgcaagcgtcgcgaacaagggcttttgtgcatgctaattgcgccattggtgcgcaaaagttccgacgcgaagtgtgaactctcaacagaaggaaacatgagacaactgaagtgccctggtttatgtgccctgctcctcctccgctgccgcctccccttctttctccttcctcccgccgagcccgctgttgcagcttgtttgcactggggcttatccggagcggaaattcctttccgtttttgtgaatgacaaactcattaacaattcatcaacacaacctgttccagccggcccgtccccacggcaacagccccttccgcagcacgctcattggctggcccggagaatgtatccattgagacgctcgctgtttgtatccattgaggagctgcctcgcgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcggtgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaatgtgtgtttttaaaaactcagttatacctatgtgtgaagtgacacattttagaactttttcattcagggattgattttgacttgtaggcatagtagggcaaggttcttttaagcttttcctagaacgtttttcagcagcagtttatgaaattcatcgtttgccacgaataaagatgacatcctagaatggaccgactgtaccgtgtatatgaacaatacctcttatgagtatagttccggcttaagattttaaagcccctgaagaaaaatgaacctatagagcatagcttgctgaggaatacaatttggatattaaccacagagaggtgtagcagaataccaagatgacagccacatgttaacctcctccctatccttcactgtcaggatcttctgctttataatgctgagataatgccaaagaggaagtagggataattctttttccagtctgttgtcatgggcaattctacctgcagatatcctagtgtgagaatgctgaatccagaatgatgtctccactttttcccctagcatgcgcatggcaaggcatatctaagcttcctcaccgtgtcaggatatggctttagaattttacattggcacttaggaggcaactttgtcatccctgttgtaatgtgcttttttgtttaactggcttgggatgtgggtcagaaacccttattgaaacttgtggggattattttagtttcttttcaagctaaagactttatatcttgccatttttcttgggacctaccctctccttacctcaaatgtaaaaatacacaaaccaaaataaaaggcaggtgtatggaatcaaaagaa

SEQ ID NO: 128265 - DNA, 1959 bp, Homo sapiens
  Payload ID: 5117
  Gene Symbol: DUSP6
  Gene Name: dual specificity phosphatase 6
  Uniprot ID: Q16828
  ENST ID: ENST00000308385
  CDS Start-End: 367-1074
gtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcggtgctcgggctgctgctcaagaagctcaaggacgagggctgccgggcgttctacctggaagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcacttt

SEQ ID NO: 128266 - DNA, 567 bp, Homo sapiens
  Payload ID: 5117
  Gene Symbol: DUSP6
  Gene Name: dual specificity phosphatase 6
  ENST ID: ENST00000548755
  CDS Start-End: 217-567
attgaggagctgcctcgcgcagggggtgtgcgaggctgagtccaagagatagcaaatcgagtcttaaataatccggggagaaagacgcccgggtagatttgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcggtgctcgggctg

SEQ ID NO: 128267 - DNA, 1074 bp, Homo sapiens
  Payload ID: 5117
  Gene Symbol: DUSP6
  Gene Name: dual specificity phosphatase 6
  ENST ID: ENST00000547291
  CDS Start-End: 122-892
aaagtgtgtttctcttatagatggttctgtatgtagggggttcgtaggatgcttgtggtgtttcttgcgccgggctgcggttcttacaagctgtgaaaactactacggcttctcaggttagatgattgcttttctcgttctggcaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattc

SEQ ID NO: 128268 - DNA, 3340 bp, Homo sapiens
  Payload ID: 5118
  Gene Symbol: DUSP7
  Gene Name: dual specificity phosphatase 7
  Uniprot ID: Q16829
  ENST ID: ENST00000495880
  CDS Start-End: 185-1444
cgcggtgcgcgcggagggccgggcgggcgggcgggacggaggccgggaggccgggaggccggggcggcgggcgcgcagctcggcgggaggcgggcgcccggagacgcggctggggcccgcgcggccggggcgccgtcccagggcagggctgcccggccccggccccgggccgcccgcgctccccatgaaaaaccagctccgcggccccccagcgcgggcgcacatgtcgacttcgggggcggcggcggctgggggcacccgggcggggtccgagcccggtgcggggtcggggtccggcgcaggcaccggggcgggcgcggcgacgggggcaggggccatgccctgcaagagcgccgagtggctgcaggaggagctggaggcgcgcggcggcgcgtccttgctgctgctcgactgccggccgcacgagctcttcgagtcgtcgcacatcgagacggccatcaacctggccatcccgggcctcatgttgcgccgcctgcgcaagggcaacctgcccatccgctccatcatccccaaccacgccgacaaggagcgcttcgccacgcgctgcaaggcggccaccgtgctgctctacgacgaggccacggccgagtggcagcccgagcccggcgctcccgcctccgtgctcggcctgctcctacagaagctgcgcgacgacggctgccaggcctactacctccaaggtggtttcaacaagtttcaaacagagtactctgagcactgcgagaccaacgtggacagctcttcctcgccgagcagctcgccacccacctcagtgctgggcctggggggcctgcgcatcagctctgactgctccgacggcgagtcggaccgagagctgcccagcagtgccaccgagtcagacggcagccctgtgccatccagccaaccagccttccctgtccagatcctgccctacctctacctcggctgcgccaaggactccaccaacctggacgtgctcggcaagtatggcatcaagtatatcctcaatgtcacacccaacctacccaacgccttcgagcacggcggcgagttcacctacaagcagatccccatctctgaccactggagccagaacctctcccagttcttccctgaggccatcagcttcattgacgaagcccgctccaagaagtgtggtgtcctggtgcactgcctggcaggcatcagccgctcagtgacggtcactgtggcctatctgatgcagaagatgaacctgtcactcaacgacgcctacgactttgtcaagaggaaaaagtccaacatctcgcccaacttcaacttcatggggcagctgctggactttgagcggacgctggggctaagcagcccgtgcgacaaccacgcgtcgagtgagcagctctacttttccacgcccaccaaccacaacctgttcccactcaatacgctggagtccacgtgaggcctggtgcacggggggcatggcaccaggcccctgctcggctctccacagggctaggtgggagagcccaagcccgccacctctggcctgaggaacccccagatgtcacctgtgcccagaggcccaggctgatcggtgtcggagcgcccctcaccatccttgggggcagggcccgcaggcaaggtctcccactgcagggcttgctggagaggcctcggctcttggacacgtggctttgggcgtccaccagggcctcatcctgtccaggacgctcctttctgctgacagcccagccagtttggctgttttttaaagacacatccacggacctgagtttactttttacttttggcaggtaaatccaagctccctggagcacaaagagtgtttgagctcttcttgatttttcttttttttttttttttttaacaaaaagtgttattttcaggctacatgcaacagtggattgtataacccagtatttcatccctttcctgatcctgcaagagagagaaatgttcagttttgtttttcgttcaatttcaaaaagcaagtatcgtgtttgtttttgtttttgttttttaatggaaaagacagacgccatgttgaccttgaccaaatgcgttttgcacatgtgtgaagcctctgtttcctcagcgggcccttcttgaaggggtggcttactgctcttcaggtattgggacccccagtcgtgccgcctcccacccttggcccagtctgacttagctctgcattcgcctgtgatgactgctgcaagttgtgattggtgggctggatggtggtctttgcattttctgccgtctcatccatccctctggtggtccctgcagacctccctgaggcagaaggtggggaccctggggccctgccgctgtcccccaggaggtgggccgcagggggctgccaggcagtagcattagccctctggggtcagcccctaagaaggcctgggctctgagcccttttatatacttagccactacttctgtctgtctgtctgtctctctctcttcctctccctctctctctttctctctctccctctctctctctttctttctctctccccccctccctctctcttcctttcctctctcttgttgtaactgggagtggaggcccagtggctggggagacattaggtggtggggcccagcccgacctccaggttcttccttctccctagctgttgctttggtctggccactcccagcccccttgtccccttggaagcttgccctgccctcatcttgcccatgccttctactgccaggagacttgcacccatttcaaccctagggcgggggcaagtggggcaaggatggaccagcagaaggggggtaaggctctgttcacttccccctgcctccacagaacgaagccacggattccgttatcttcctccagttttgttccttctccagcctcagttccaccaggtgtcaggactgcatgggggcctggggcaggcagaggagtcaggccagggtccctgacggagcagcactcagcatgtgagtgaggccacagaaaaactctgccccactgcttcttacctcacgggggtggctttcagggattctttagcgcagcagattaaaatcttgccacagtcgagaaattgacaacaagcttccatgctgtacatggttctctttttctctcttttatttttaaaaagaaaacccagaaagatgtaccagatttgtgtaaatgagggtatgccagaaggtggccagttttgctttatgatcttatgaaggaagatttgtgaccctacgtatatatatacacacacatacatatatatatatatcccgaaccaacaacgggactttgtttatattgcaaataaatattattttttctttaaaa

SEQ ID NO: 128269 - DNA, 3059 bp, Homo sapiens
  Payload ID: 5118
  Gene Symbol: DUSP7
  Gene Name: dual specificity phosphatase 7
  ENST ID: ENST00000469623
  CDS Start-End: 1-828
ggcggcgcgtccttgctgctgctcgactgccggccgcacgagctcttcgagtcgtcgcacatcgagacggccatcaacctggccatcccgggcctcatgttgcgccgcctgcgcaagggcaacctgcccatccgctccatcatccccaaccacgccgacaaggagcgcttcgccacgcgctgcaaggcggccaccgtgctgctctacgacgaggccacggccgagtggcagcccgagcccggcgctcccgcctccgtgctcggcctgctcctacagaagctgcgcgacgacggctgccaggcctactacctccaaggtggtttcaacaagtttcaaacagagtactctgagcactgcgagaccaacgtggacagctcttcctcgccgagcagctcgccacccacctcagtgctgggcctggggggcctgcgcatcagctctgactgctccgacggcgagtcggaccgagagctgcccagcagtgccaccgagtcagacggcagccctgtgccatccagccaaccagccttccctgtccagatcctgccctacctctacctcggctgcgccaaggactccaccaacctggacgtgctcggcaagtatggcatcaagtatatcctcaatgtcacacccaacctacccaacgccttcgagcacggcggcgagttcacctacaagcagatccccatctctgaccactggagccagaacctctcccagttcttccctgaggccatcagcttcattggtaggtgctgtgtgctgggcaggggggtgtgggtgcatcaaggtgtatgcaggactctgggtggcgcccccgcctgactgggtacctctgggcctgttgagacctgtgtgtgccctacgtgtgccagcgtgtgcccgtgggtgtacccaggcctactgtgagtcaccgagtcccttgggcccctctacctgttggggcctgagcagtctcctgagtcctgagctccccctagctgacagcacgtcatgggctctctgctgtccagcttgtgttttcctggcttagatgttgtttcgggcttagcaagctgaaacatcacagcgcacagacctcccacgggtctcacttgctccgcatcacgcctcagcacacgtgtctctccaggatggggttgtcatagtgcctctttgggctttaatgtggacctaagagggctgaaaggtagccctggagccagaggcacaccccaaacaggcagctattgaaatgtggtgactgctagctcagtcagcctccagatgctctctgcagcctgtagggcttgcttggagtgtagggaggagtgcaagagaaggtgggggagtggagaaaggccttccccagagcagtgtgtcctgctgtctggcttagtgcccttcgagtccctgtatccccagcctcagcagactcgggtccccactgctttctccttggccagctggaggctgagaccacaggtcatctcccctggcccagggtgcaaggaaggggcacgagggctcaggatgaatgtaaacgctctatctctgagcctggtgacccaatgtttctgcccagcctccagtggcaaggtgtgggggtggcccgggctgtcttttcccgatggtggctgtgtccagtggagggcgttttggtgtcggctgggctgggctagctttaacaacaggaagtgggaggcttccccgcctcatccgcttactgggaaccaaaagtaggtgcctggctgggaggaaggaaggaagctgaggcctgggggaggggctgcaactggggctgcctggagcttctcagccctgcccaccaccccctgggtcaagagggctaggggtgctgcctcagcatttgaactcccccaacgagggaggggaatagagagagggaagcaggcttcgccaggctgggcctggctagtgggtacctttatccttcctgaaagctcctccccgtctgggtagggggacctttttcctcatttgacaagtgaaggaattgaggcccaggcatcccttaggagtcagtgggacaggatcagtcaccagctacaccctgaaaaggccaaaaataaagccagcagaaacagactgtctttggatcacctggaggtgggtttggaggccaggcgttcctcacatcctggtgtcaccactggaggctggtcccagcacccccttttcccacccccaatctcgaggtctgaccacacagctcctcatgaagctgcaatgtctgtctccttgccagatgatcctgccccagtgccttagccatggggccccctgtcagtccctgagtctggaggaagcacctactgtatgctttactccttggttgggaggggatgggagaggaagctctgtcaggacaaaggcaacgaagaacagtgggtgaacccgtatgtcatcttgtaggaaggcattgattgcgtgctagctgtgtgcctggctcctggagggttcagagtcagggtggtggggacatcaaggaccccatggctgcctcttgtgaatctatgtccctggcacagctgtggcacacagagaggcagctgccccggggtccaggagagattacaggactgagttgttcagtagctcggccagtatttattgagcttctatgtgtcagacagaggagtctgagggtggcactgggggaagctgggagggttggaggggaaaggggacaggaaggttggccccatccagtcagctgtggtaggagatatcactgacacatgggcctcctgaggaaggtctagcaagtggcaggggtggggcccatttaagcacacctcacttatgaagccccatcacaagtgatagtgtggccatcatcccagtccatgtgtcttaggagctggagttaaggccttggggactagctgggcagatggcagagcgaaatgcagggccaggccacctacttccttccagaggagcctccctcaggccactttcctagaagactctcagggacaacccatgggagcggctccaagagaaccagcccagcccccagtcccaggtcatggcctggcagcagcgggcgc

SEQ ID NO: 128270 - DNA, 4455 bp, Homo sapiens
  Payload ID: 5119
  Gene Symbol: DUSP8
  Gene Name: dual specificity phosphatase 8
  Uniprot ID: Q13202
  ENST ID: ENST00000331588
  CDS Start-End: 111-1988
aggtccagcaccatgtgctaggtcactcccagcgcgaggccacacctgggccgtcggagcagcccctcctcacttcaggggtcaccctccccagcacccattgccccaccatggctggggaccggctcccgaggaaggtgatggatgccaagaagctggccagcctgctgcggggcgggcctggggggccgctggtcatcgacagccgctccttcgtggagtacaacagctggcatgtgctcagctccgtcaacatctgctgctccaagctggtgaagcggcggctgcagcagggcaaggtgaccattgcggagctcatccagccggctgcacgcagccaggtggaggctacggagccacaggacgtggtggtctatgaccagagcacgcgggacgccagcgtgctggccgcagacagcttcctctccatcctgctgagcaagctggacggctgcttcgacagcgtggccatcctcactgggggcttcgccaccttctcctcctgcttccccggcctctgcgagggcaagcctgctgccctgctacccatgagcctctcccagccctgcctgcctgtgcccagcgtgggcctgacccgcatcctgcctcacctctacctgggctcgcagaaggacgtcctaaacaaggatctgatgacgcaaaatggaataagctacgtcctcaacgccagcaactcctgccccaagcctgacttcatctgcgagagccgcttcatgcgggtccccatcaacgacaactactgtgaaaaactgctgccctggctggacaagtccatcgagttcatcgataaagccaagctctccagctgccaagtcatcgtccactgtctggctggcatctcccgctctgccaccatcgccatcgcctacatcatgaagaccatgggcatgtcctccgacgacgcctacaggttcgtgaaggacaggcgcccgtccatctcgcccaacttcaacttcctgggccagctgctggagtacgagcgcagcctgaagctgctggccgccctgcagggcgacccgggcaccccctcagggacgccggagcctccgcccagtcctgccgccggggccccgctgccacggctgccaccacctacctcagagagcgctgccacagggaatgcggctgccagggagggcggcctgagcgcgggcggggagccccccgcgccccccacgcccccggcgaccagcgcactgcagcagggcctgcgcggcctgcacctctcctcggaccgcctgcaggacactaaccgcctcaagcgctccttctccctggacatcaagtctgcctacgcccctagcaggcggcccgacggccccgggccccccgaccccggcgaggccccgaagctctgcaagctggacagcccgtcgggggccgcgctgggcctgtcctcgcccagcccggacagcccggacgccgcgcctgaggcgcgcccacggccccgccggcggccccggccccccgccggctcccccgcgcgctcccccgcgcacagcctcggcctgaacttcggcgatgcggcccggcagactccgcggcacggcctctcggccctgtcggcgcccgggctgcccggccctggccagccggccggccccggggcctgggcaccgccgctcgactccccaggcacgccgtcgcccgacgggccctggtgcttcagccccgagggcgcacagggggcgggcggggtgctgtttgcgcccttcggccgggcgggcgccccgggaccaggcggcggcagcgacctgcggcggcgggaggcagcgagggctgagccccgggacgcgcggaccggctggcccgaggagccggccccggagacgcagttcaagcgccgcagctgccagatggagttcgaggagggcatggtggaggggcgcgcgcgcggcgaggagctggccgccctgggcaagcaggcgagcttctcgggcagcgtggaggtcatcgaggtgtcctgacccctccgctgccctcggccccgccgcccgcagccaggcccgttataaatgtatattatatataatgcaaagaaaggtaaatggttttactgggatttttatcgagaagtaaatatttcgattttttatttatttaagctgttcattctggcaatgatttggcaacagtgcgggtggtcctcgagctctatttttactgtctggtatttaaactgaaacatacgtttctaagcaatacgaggccaccttcagtcgcaagctgggtgccaggcctggggcccctcccagttcccccgccccaggaaacactgctgacctttgcaaaggctgccgagctttcgtgcactttttacataacaaaaaggtgaaaaaaaggaaaaaaaaacttctttgccacaaactgagccgcagaaccccccttctccccccacccacctcccctgctccctcccttctctgcgccggcctagggctctgcaccaaagccataggatggaggagcaggagctggtgtgccccggagaggtgcggccagccctccatcagctccaggcaccaaatcttggtggcaaggagggcaccccgctgcccgttgccccagagctgttctctggcaggggaggacaggcattgggcttcatggtgccagggtgttcagaggggctgagaaatagaacagtgtgtgtaggggcttcgggcagggggttctggaacgtcagatgaggtgcagcccaggggaggacagaggtgttagtgcccccaactcctgccagagccccagtccagccacagagtggctcagaaaggccattcctagagggctgcggccctcccttctcccttgcccatgcccccagagctgcctgccgggcagggtggcaccattgcaggagaggagcttggcctccgggggtcaggcaggaggcgcctggctagccagtgctggctccactgggcaggaagccctggacccccaggtatgaggagggggtggtcttagggttctgttccaggtctgccccgcccccctcccagccatgccccaggcagaacttggaattcaggtgtgcacctgcaggctgaggggctctgtgagcaggtgctgctcacacagggagttcaggcgccagccaagcccctgtgctgctgggataggcctgcttcacttagggagcactgcctcaagacaggtaaagccccctcgtttgcccccacccccatggggccgctcaggagagaaactcccattcacccctttcccagggtgctctctctctaggtggcatgccagcccccaaacacaagtggcttttgggcccaggtgggtcagcctgctgcccctgccccataccccctcgggccattgggacccctgcccttcagatgtcctagggtctaggagtggggccagtcactgtgggaagaggccaggggcttggccggagaggcagcccagggcaggacccagtcctgagtcctggagcagggccagggaggcgcccatcccgccccagccagccgccctctctgctgtttcttctatttgttcttcttttcacccacagctctgtgttcctgtcatccctcctttcagcaaaagtcctgttcccgttccctctgtccccacccactcctgttcccccaagaaaataagctatcgttgtatttgcaatctatggattagaggtttaagtatttattattattggttaattattattaattatgtaaatttgcctcccatatgtctgttgcgttgggtttctgaggagaccctgggtgaggaggatgcactggcttcccgcttctcgccccccacccctgtgctgtccgggagacagtggtctggggccactggttgggcccccttctcccttcccccttccccttgtcccttctgcaggccgttgaggggggctgtctgtctcagtctgtctctgctcccactcttgaggcactggttaccgcaaagtgagcagccagcaggggggcgaaggtcctgtgttggccactgcctcctccagtgctgcaggaggcgggctgaggccccacctggtggctttcacctgacccagccctgagtcctctccaagcctctctccggcccctcccacctggccactgcctcctccagtgctgcgggaggcgggccagggccccacctggtggctttcacctgacccagccctgagtcctctccaagcctctctccggcccctcccacctggccactgcctggcattgggatcgccccaaaatggacccggcccctcctgttatttgctgggaagtccagcggaggagagggtgcaggtcccccgctgagcctccagtctctgtagactgggctgccggcccttcagccccccttggagcccctcccgccacagccgcaccttctgctcccggcccctccctttgtatttggagacaatgtgttgtaataaagcttaaagtggatgttttc

SEQ ID NO: 128271 - DNA, 4480 bp, Homo sapiens
  Payload ID: 5119
  Gene Symbol: DUSP8
  Gene Name: dual specificity phosphatase 8
  Uniprot ID: Q13202
  ENST ID: ENST00000397374
  CDS Start-End: 129-2006
ccgaggcgagcgcgagcgaggtccagcaccatgtgctaggtcactcccagcgcgaggccacacctgggccgtcggagcagcccctcctcacttcaggggtcaccctccccagcacccattgccccaccatggctggggaccggctcccgaggaaggtgatggatgccaagaagctggccagcctgctgcggggcgggcctggggggccgctggtcatcgacagccgctccttcgtggagtacaacagctggcatgtgctcagctccgtcaacatctgctgctccaagctggtgaagcggcggctgcagcagggcaaggtgaccattgcggagctcatccagccggctgcacgcagccaggtggaggctacggagccacaggacgtggtggtctatgaccagagcacgcgggacgccagcgtgctggccgcagacagcttcctctccatcctgctgagcaagctggacggctgcttcgacagcgtggccatcctcactgggggcttcgccaccttctcctcctgcttccccggcctctgcgagggcaagcctgctgccctgctacccatgagcctctcccagccctgcctgcctgtgcccagcgtgggcctgacccgcatcctgcctcacctctacctgggctcgcagaaggacgtcctaaacaaggatctgatgacgcaaaatggaataagctacgtcctcaacgccagcaactcctgccccaagcctgacttcatctgcgagagccgcttcatgcgggtccccatcaacgacaactactgtgaaaaactgctgccctggctggacaagtccatcgagttcatcgataaagccaagctctccagctgccaagtcatcgtccactgtctggctggcatctcccgctctgccaccatcgccatcgcctacatcatgaagaccatgggcatgtcctccgacgacgcctacaggttcgtgaaggacaggcgcccgtccatctcgcccaacttcaacttcctgggccagctgctggagtacgagcgcagcctgaagctgctggccgccctgcagggcgacccgggcaccccctcagggacgccggagcctccgcccagtcctgccgccggggccccgctgccacggctgccaccacctacctcagagagcgctgccacagggaatgcggctgccagggagggcggcctgagcgcgggcggggagccccccgcgccccccacgcccccggcgaccagcgcactgcagcagggcctgcgcggcctgcacctctcctcggaccgcctgcaggacactaaccgcctcaagcgctccttctccctggacatcaagtctgcctacgcccctagcaggcggcccgacggccccgggccccccgaccccggcgaggccccgaagctctgcaagctggacagcccgtcgggggccgcgctgggcctgtcctcgcccagcccggacagcccggacgccgcgcctgaggcgcgcccacggccccgccggcggccccggccccccgccggctcccccgcgcgctcccccgcgcacagcctcggcctgaacttcggcgatgcggcccggcagactccgcggcacggcctctcggccctgtcggcgcccgggctgcccggccctggccagccggccggccccggggcctgggcaccgccgctcgactccccaggcacgccgtcgcccgacgggccctggtgcttcagccccgagggcgcacagggggcgggcggggtgctgtttgcgcccttcggccgggcgggcgccccgggaccaggcggcggcagcgacctgcggcggcgggaggcagcgagggctgagccccgggacgcgcggaccggctggcccgaggagccggccccggagacgcagttcaagcgccgcagctgccagatggagttcgaggagggcatggtggaggggcgcgcgcgcggcgaggagctggccgccctgggcaagcaggcgagcttctcgggcagcgtggaggtcatcgaggtgtcctgacccctccgctgccctcggccccgccgcccgcagccaggcccgttataaatgtatattatatataatgcaaagaaaggtaaatggttttactgggatttttatcgagaagtaaatatttcgattttttatttatttaagctgttcattctggcaatgatttggcaacagtgcgggtggtcctcgagctctatttttactgtctggtatttaaactgaaacatacgtttctaagcaatacgaggccaccttcagtcgcaagctgggtgccaggcctggggcccctcccagttcccccgccccaggaaacactgctgacctttgcaaaggctgccgagctttcgtgcactttttacataacaaaaaggtgaaaaaaaggaaaaaaaaacttctttgccacaaactgagccgcagaaccccccttctccccccacccacctcccctgctccctcccttctctgcgccggcctagggctctgcaccaaagccataggatggaggagcaggagctggtgtgccccggagaggtgcggccagccctccatcagctccaggcaccaaatcttggtggcaaggagggcaccccgctgcccgttgccccagagctgttctctggcaggggaggacaggcattgggcttcatggtgccagggtgttcagaggggctgagaaatagaacagtgtgtgtaggggcttcgggcagggggttctggaacgtcagatgaggtgcagcccaggggaggacagaggtgttagtgcccccaactcctgccagagccccagtccagccacagagtggctcagaaaggccattcctagagggctgcggccctcccttctcccttgcccatgcccccagagctgcctgccgggcagggtggcaccattgcaggagaggagcttggcctccgggggtcaggcaggaggcgcctggctagccagtgctggctccactgggcaggaagccctggacccccaggtatgaggagggggtggtcttagggttctgttccaggtctgccccgcccccctcccagccatgccccaggcagaacttggaattcaggtgtgcacctgcaggctgaggggctctgtgagcaggtgctgctcacacagggagttcaggcgccagccaagcccctgtgctgctgggataggcctgcttcacttagggagcactgcctcaagacaggtaaagccccctcgtttgcccccacccccatggggccgctcaggagagaaactcccattcacccctttcccagggtgctctctctctaggtggcatgccagcccccaaacacaagtggcttttgggcccaggtgggtcagcctgctgcccctgccccataccccctcgggccattgggacccctgcccttcagatgtcctagggtctaggagtggggccagtcactgtgggaagaggccaggggcttggccggagaggcagcccagggcaggacccagtcctgagtcctggagcagggccagggaggcgcccatcccgccccagccagccgccctctctgctgtttcttctatttgttcttcttttcacccacagctctgtgttcctgtcatccctcctttcagcaaaagtcctgttcccgttccctctgtccccacccactcctgttcccccaagaaaataagctatcgttgtatttgcaatctatggattagaggtttaagtatttattattattggttaattattattaattatgtaaatttgcctcccatatgtctgttgcgttgggtttctgaggagaccctgggtgaggaggatgcactggcttcccgcttctcgccccccacccctgtgctgtccgggagacagtggtctggggccactggttgggcccccttctcccttcccccttccccttgtcccttctgcaggccgttgaggggggctgtctgtctcagtctgtctctgctcccactcttgaggcactggttaccgcaaagtgagcagccagcaggggggcgaaggtcctgtgttggccactgcctcctccagtgctgcaggaggcgggctgaggccccacctggtggctttcacctgacccagccctgagtcctctccaagcctctctccggcccctcccacctggccactgcctcctccagtgctgcgggaggcgggccagggccccacctggtggctttcacctgacccagccctgagtcctctccaagcctctctccggcccctcccacctggccactgcctggcattgggatcgccccaaaatggacccggcccctcctgttatttgctgggaagtccagcggaggagagggtgcaggtcccccgctgagcctccagtctctgtagactgggctgccggcccttcagccccccttggagcccctcccgccacagccgcaccttctgctcccggcccctccctttgtatttggagacaatgtgttgtaataaagcttaaagtggatgttttccccacga

SEQ ID NO: 128272 - DNA, 4455 bp, Homo sapiens; identical to SEQ ID NO: 128270
  Payload ID: 5119
  Gene Symbol: DUSP8
  Gene Name: dual specificity phosphatase 8
  Uniprot ID: Q13202
  ENST ID: ENST00000610856
  CDS Start-End: 111-1988

SEQ ID NO: 128273 - DNA, 4455 bp, Homo sapiens
  Payload ID: 5119
  Gene Symbol: DUSP8
  Gene Name: dual specificity phosphatase 8
  Uniprot ID: Q13202
  ENST ID: ENST00000617829
  CDS Start-End: 111-1988
aggtccagcaccatgtgctaggtcactcccagcgcgaggccacacctgggccgtcggagcagcccctcctcacttcaggggtcaccctccccagcacccattgccccaccatggctggggaccggctcccgaggaaggtgatggatgccaagaagctggccagcctgctgcggggcgggcctggggggccgctggtcatcgacagccgctccttcgtggagtacaacagctggcatgtgctcagctccgtcaacatctgctgctccaagctggtgaagcggcggctgcagcagggcaaggtgaccattgcggagctcatccagccggctgcacgcagccaggtggaggctacggagccacaggacgtggtggtctatgaccagagcacgcgggacgccagcgtgctggccgcagacagcttcctctccatcctgctgagcaagctggacggctgcttcgacagcgtggccatcctcactgggggcttcgccaccttctcctcctgcttccccggcctctgcgagggcaagcctgctgccctgctacccatgagcctctcccagccctgcctgcctgtgcccagcgtgggcctgacccgcatcctgcctcacctctacctgggctcgcagaaggacgtcctaaacaaggatctgatgacgcaaaatggaataagctacgtcctcaacgccagcaactcctgccccaagcctgacttcatctgcgagagccgcttcatgcgggtccccatcaacgacaactactgtgaaaaactgctgccctggctggacaagtccatcgagttcatcgataaagccaagctctccagctgccaagtcatcgtccactgtctggctggcatctcccgctctgccaccatcgccatcgcctacatcatgaagaccatgggcatgtcctccgacgacgcctacaggttcgtgaaggacaggcgcccgtccatctcgcccaacttcaacttcctgggccagctgctggagtacgagcgcagcctgaagctgctggccgccctgcagggcgacccgggcaccccctcagggacgccggagcctccgcccagtcctgccgccggggccccgctgccacggctgccaccacctacctcagagagcgctgccacagggaatgcggctgccagggagggcggcctgagcgcgggcggggagccccccgcgccccccacgcccccggcgaccagcgcactgcagcagggcctgcgcggcctgcacctctcctcggaccgcctgcaggacactaaccgcctcaagcgctccttctccctggacatcaagtctgcctacgcccctagcaggcggcccgacggccccgggccccccgaccccggcgaggccccgaagctctgcaagctggacagcccgtcgggggccgcgctgggcctgtcctcgcccagcccggacagcccggacgccgcgcctgaggcgcgcccacggccccgccggcggccccggccccccgccggctcccccgcgcgctcccccgcgcacagcctcggcctgaacttcggcgatgcggcccggcagactccgcggcacggcctctcggccctgtcggcgcccgggctgcccggccctggccagccggccggccccggggcctgggcaccgccgctcgactccccaggcacgccgtcgcccgacgggccctggtgcttcagccccgagggcgcacagggggcgggcggggtgctgtttgcgcccttcggccgggcgggcgccccgggaccaggcggcggcagcgacctgcggcggcgggaggcagcgagggctgagccccgggacgcgcggaccggctggcccgaggagccggccccggagacgcagttcaagcgccgcagctgccagatggagttcgaggagggcatggtggaggggcgcgcgcgcggcgaggagctggccgccctgggcaagcaggcgagcttctcgggcagcgtggaggtcatcgaggtgtcctgacccctccgctgccctcggccccgccgcccgcagccaggcccgttataaatgtatattatatataatgcaaagaaaggtaaatggttttactgggatttttatcgagaagtaaatatttcgattttttatttatttaagctgttcattctggcaatgatttggcaacagtgcgggtggtcctcgagctctatttttactgtctggtatttaaactgaaacatacgtttctaagcaatacgaggccaccttcagtcgcaagctgggtgccaggcctggggcccctcccagttcccccgccccaggaaacactgctgacctttgcaaaggctgccgagctttcgtgcactttttacataacaaaaaggtgaaaaaaaggaaaaaaaaacttctttgccacaaactgagccgcagaaccccccttctccccccacccacctcccctgctccctcccttctctgcgccggcctagggctctgcaccaaagccataggatggaggagcaggagctggtgtgccccggagaggtgcggccagccctccatcagctccaggcaccaaatcttggtggcaaggagggcaccccgctgcccgttgccccagagctgttctctggcaggggaggacaggcattgggcttcatggtgccagggtgttcagaggggctgagaaatagaacagtgtgtgtaggggcttcgggcagggggttctggaacgtcagatgaggtgcagcccaggggaggacagaggtgttagtgcccccaactcctgccagagccccagtccagccacagagtggctcagaaaggccattcctagagggctgcggccctcccttctcccttgcccatgcccccagagctgcctgccgggcagggtggcaccattgcaggagaggagcttggcctccgggggtcaggcaggaggcgcctggctagccagtgctggctccactgggcaggaagccctggacccccaggtatgaggagggggtggtcttagggttctgttccaggtctgccccgcccccctcccagccatgccccaggcagaacttggaattcaggtgtgcacctgcaggctgaggggctctgtgagcaggtgctgctcacacagggagttcaggcgccagccaagcccctgtgctgctgggataggcctgcttcacttagggagcactgcctcaagacaggtaaagccccctcgtttgcccccacccccatggggccgctcaggagagaaactcccattcacccctttcccagggtgctctctctctaggtggcatgccagcccccaaacacaagtggcttttgggcccaggtgggtcagcctgctgcccctgccccataccccctcgggccattgggacccctgcccttcagatgtcctagggtctaggagtggggccagtcactgtgggaagaggccaggggcttggccggagaggcagcccagggcaggacccagtcctgagtcctggagcagggccagggaggcgcccatcccgccccggccagccgccctctctgctgtttcttctatttgttcttcttttcacccacagctctgtgttcctgtcatccctcctttcagcaaaagtcctgttcccgttccctctgtccccacccactcctgttcccccaagaaaataagctatcgttgtatttgcaatctatggattagaggtttaagtatttattattattggttaattattattaattatgtaaatttgcctcccatatgtctgttgcgttgggtttctgaggagaccctgggtgaggaggatgcactggcttcccgcttctcgccccccacccctgtgctgtccgggagacagtggtctggggccactggttgggcccccttctcccttcccccttccccttgtcccttctgcaggccgttgaggggggctgtctgtctcagtctgtctctgctcccactcttgaggcactggttaccgcaaagtgagcagccagcaggggggcgaaggtcctgtgttggccactgcctcctccagtgctgcaggaggcgggctgaggccccacctggtggctttcacctgacccagccctgagtcctctccaagcctctctccggcccctcccacctggccactgcctcctccagtgctgcgggaggcgggccagggccccacctggtggctttcacctgacccagccctgagtcctctccaagcctctctccggcccctcccacctggccactgcctggcattgggatcgccccaaaatggacccggcccctcctgttatttgctgggaagtccagcggaggagagggtgcaggtcccccgctgagcctccagtctctgtagactgggctgccggcccttcagccccccttggagcccctcccgccacagccgcaccttctgctcccggcccctccctttgtatttggagacaatgtgttgtaataaagcttaaagtggatgttttc

SEQ ID NO: 128274 - DNA, 4480 bp, Homo sapiens
  Payload ID: 5119
  Gene Symbol: DUSP8
  Gene Name: dual specificity phosphatase 8
  Uniprot ID: Q13202
  ENST ID: ENST00000625578
  CDS Start-End: 129-2006
ccgaggcgagcgcgagcgaggtccagcaccatgtgctaggtcactcccagcgcgaggccacacctgggccgtcggagcagcccctcctcacttcaggggtcaccctccccagcacccattgccccaccatggctggggaccggctcccgaggaaggtgatggatgccaagaagctggccagcctgctgcggggcgggcctggggggccgctggtcatcgacagccgctccttcgtggagtacaacagctggcatgtgctcagctccgtcaacatctgctgctccaagctggtgaagcggcggctgcagcagggcaaggtgaccattgcggagctcatccagccggctgcacgcagccaggtggaggctacggagccacaggacgtggtggtctatgaccagagcacgcgggacgccagcgtgctggccgcagacagcttcctctccatcctgctgagcaagctggacggctgcttcgacagcgtggccatcctcactgggggcttcgccaccttctcctcctgcttccccggcctctgcgagggcaagcctgctgccctgctacccatgagcctctcccagccctgcctgcctgtgcccagcgtgggcctgacccgcatcctgcctcacctctacctgggctcgcagaaggacgtcctaaacaaggatctgatgacgcaaaatggaataagctacgtcctcaacgccagcaactcctgccccaagcctgacttcatctgcgagagccgcttcatgcgggtccccatcaacgacaactactgtgaaaaactgctgccctggctggacaagtccatcgagttcatcgataaagccaagctctccagctgccaagtcatcgtccactgtctggctggcatctcccgctctgccaccatcgccatcgcctacatcatgaagaccatgggcatgtcctccgacgacgcctacaggttcgtgaaggacaggcgcccgtccatctcgcccaacttcaacttcctgggccagctgctggagtacgagcgcagcctgaagctgctggccgccctgcagggcgacccgggcaccccctcagggacgccggagcctccgcccagtcctgccgccggggccccgctgccacggctgccaccacctacctcagagagcgctgccacagggaatgcggctgccagggagggcggcctgagcgcgggcggggagccccccgcgccccccacgcccccggcgaccagcgcactgcagcagggcctgcgcggcctgcacctctcctcggaccgcctgcaggacactaaccgcctcaagcgctccttctccctggacatcaagtctgcctacgcccctagcaggcggcccgacggccccgggccccccgaccccggcgaggccccgaagctctgcaagctggacagcccgtcgggggccgcgctgggcctgtcctcgcccagcccggacagcccggacgccgcgcctgaggcgcgcccacggccccgccggcggccccggccccccgccggctcccccgcgcgctcccccgcgcacagcctcggcctgaacttcggcgatgcggcccggcagactccgcggcacggcctctcggccctgtcggcgcccgggctgcccggccctggccagccggccggccccggggcctgggcaccgccgctcgactccccaggcacgccgtcgcccgacgggccctggtgcttcagccccgagggcgcacagggggcgggcggggtgctgtttgcgcccttcggccgggcgggcgccccgggaccaggcggcggcagcgacctgcggcggcgggaggcagcgagggctgagccccgggacgcgcggaccggctggcccgaggagccggccccggagacgcagttcaagcgccgcagctgccagatggagttcgaggagggcatggtggaggggcgcgcgcgcggcgaggagctggccgccctgggcaagcaggcgagcttctcgggcagcgtggaggtcatcgaggtgtcctgacccctccgctgccctcggccccgccgcccgcagccaggcccgttataaatgtatattatatataatgcaaagaaaggtaaatggttttactgggatttttatcgagaagtaaatatttcgattttttatttatttaagctgttcattctggcaatgatttggcaacagtgcgggtggtcctcgagctctatttttactgtctggtatttaaactgaaacatacgtttctaagcaatacgaggccaccttcagtcgcaagctgggtgccaggcctggggcccctcccagttcccccgccccaggaaacactgctgacctttgcaaaggctgccgagctttcgtgcactttttacataacaaaaaggtgaaaaaaaggaaaaaaaaacttctttgccacaaactgagccgcagaaccccccttctccccccacccacctcccctgctccctcccttctctgcgccggcctagggctctgcaccaaagccataggatggaggagcaggagctggtgtgccccggagaggtgcggccagccctccatcagctccaggcaccaaatcttggtggcaaggagggcaccccgctgcccgttgccccagagctgttctctggcaggggaggacaggcattgggcttcatggtgccagggtgttcagaggggctgagaaatagaacagtgtgtgtaggggcttcgggcagggggttctggaacgtcagatgaggtgcagcccaggggaggacagaggtgttagtgcccccaactcctgccagagccccagtccagccacagagtggctcagaaaggccattcctagagggctgcggccctcccttctcccttgcccatgcccccagagctgcctgccgggcagggtggcaccattgcaggagaggagcttggcctccgggggtcaggcaggaggcgcctggctagccagtgctggctccactgggcaggaagccctggacccccaggtatgaggagggggtggtcttagggttctgttccaggtctgccccgcccccctcccagccatgccccaggcagaacttggaattcaggtgtgcacctgcaggctgaggggctctgtgagcaggtgctgctcacacagggagttcaggcgccagccaagcccctgtgctgctgggataggcctgcttcacttagggagcactgcctcaagacaggtaaagccccctcgtttgcccccacccccatggggccgctcaggagagaaactcccattcacccctttcccagggtgctctctctctaggtggcatgccagcccccaaacacaagtggcttttgggcccaggtgggtcagcctgctgcccctgccccataccccctcgggccattgggacccctgcccttcagatgtcctagggtctaggagtggggccagtcactgtgggaagaggccaggggcttggccggagaggcagcccagggcaggacccagtcctgagtcctggagcagggccagggaggcgcccatcccgccccggccagccgccctctctgctgtttcttctatttgttcttcttttcacccacagctctgtgttcctgtcatccctcctttcagcaaaagtcctgttcccgttccctctgtccccacccactcctgttcccccaagaaaataagctatcgttgtatttgcaatctatggattagaggtttaagtatttattattattggttaattattattaattatgtaaatttgcctcccatatgtctgttgcgttgggtttctgaggagaccctgggtgaggaggatgcactggcttcccgcttctcgccccccacccctgtgctgtccgggagacagtggtctggggccactggttgggcccccttctcccttcccccttccccttgtcccttctgcaggccgttgaggggggctgtctgtctcagtctgtctctgctcccactcttgaggcactggttaccgcaaagtgagcagccagcaggggggcgaaggtcctgtgttggccactgcctcctccagtgctgcaggaggcgggctgaggccccacctggtggctttcacctgacccagccctgagtcctctccaagcctctctccggcccctcccacctggccactgcctcctccagtgctgcgggaggcgggccagggccccacctggtggctttcacctgacccagccctgagtcctctccaagcctctctccggcccctcccacctggccactgcctggcattgggatcgccccaaaatggacccggcccctcctgttatttgctgggaagtccagcggaggagagggtgcaggtcccccgctgagcctccagtctctgtagactgggctgccggcccttcagccccccttggagcccctcccgccacagccgcaccttctgctcccggcccctccctttgtatttggagacaatgtgttgtaataaagcttaaagtggatgttttccccacga

SEQ ID NO: 128275 - DNA, 4480 bp, Homo sapiens; identical to SEQ ID NO: 128271
  Payload ID: 5119
  Gene Symbol: DUSP8
  Gene Name: dual specificity phosphatase 8
  Uniprot ID: Q13202
  ENST ID: ENST00000629053
  CDS Start-End: 129-2006

SEQ ID NO: 128276 - DNA, 2433 bp, Homo sapiens
  Payload ID: 5120
  Gene Symbol: DUSP9
  Gene Name: dual specificity phosphatase 9
  Uniprot ID: Q99956
  ENST ID: ENST00000342782
  CDS Start-End: 266-1420
agtttccaaggtggaagctgggtccggctgccaggaagcggccggtgcgcgggctgcgcgggctgcgcggggctcggcttccacgtgcgagcctgcaccgccgccccgccctctcctggcggccaggcctggggactctctgccgcgggacggcgcctcgcgttccgccgtggcagtggccgtggccagaacgtccacgcgcggtcgtccaccgccggatctcgctccagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattgatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaggcccaggtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagagtgcagtggccgcccacatccatggcctaggagctactgggcaggttcccggccacacatctggtgggctgttttgttttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaa

SEQ ID NO: 128277 - DNA, 2289 bp, Homo sapiens
  Payload ID: 5120
  Gene Symbol: DUSP9
  Gene Name: dual specificity phosphatase 9
  Uniprot ID: Q99956
  ENST ID: ENST00000370167
  CDS Start-End: 114-1268
cgcttcccgccgcccgagcttcggaaacttcccggccgcgacgcagggaaccggcgcggagaaccgagcagagcggagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattgatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaggcccaggtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagagtgcagtggccgcccacatccatggcctaggagctactgggcaggttcccggccacacatctggtgggctgttttgttttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagatactga

SEQ ID NO: 128278 - DNA, 663 bp, Homo sapiens
  Payload ID: 5121
  Gene Symbol: DUPD1
  Gene Name: dual specificity phosphatase and pro isomerase domain containing 1
  Uniprot ID: Q68J44
  ENST ID: ENST00000338487
  CDS Start-End: 1-663
atgacatctggagaagtgaagacaagcctcaagaatgcctactcatctgccaagaggctgtcgccgaagatggaggaggaaggggaggaggaggactactgcacccctggagcctttgagctggagcggctcttctggaagggcagtccccagtacacccacgtcaacgaggtctggcccaagctctacattggcgatgaggcgacggcgctggaccgctataggctgcagaaggcggggttcacgcacgtgctgaacgcggcccacggccgctggaacgtggacactgggcccgactactaccgcgacatggacatccagtaccacggcgtggaggccgacgacctgcccaccttcgacctcagtgtcttcttctacccggcggcagccttcatcgacagagcgctaagcgacgaccacagtaagatcctggttcactgcgtcatgggccgcagccggtcagccaccctggtcctggcctacctgatgatccacaaggacatgaccctggtggacgccatccagcaagtggccaagaaccgctgcgtcctcccgaaccggggctttttgaagcagctccgggagctggacaagcagctggtgcagcagaggcgacggtcccagcgccaggacggtgaggaggaggatggcagggagctgtag

SEQ ID NO: 128279 - DNA, 663 bp, Homo sapiens; identical to SEQ ID NO: 128278
  Payload ID: 5121
  Gene Symbol: DUPD1
  Gene Name: Dual specificity phosphatase and pro isomerase domain containing 1
  ENST ID: ENST00000625469
  CDS Start-End: 1-663

SEQ ID NO: 128280 - DNA, 8654 bp, Homo sapiens
  Payload ID: 5122
  Gene Symbol: DYRK1A
  Gene Name: dual-specificity tyrosine-(Y)-phosphorylation regulated kinase 1A
  Uniprot ID: Q13627
  ENST ID: ENST00000339659
  CDS Start-End: 1471-3735
aaaaataactcatattgtctctgaggttcttttccagtgaagtgtttagtattgctgctatttggagtacaaagttggagcttttaaagaacctgggagttcaaaagtataaggagaaataaatgaaaagcagaaatattttgaggcaataagtatagactcaaatctatattatgacccacttgtagcaccacttggaattctaccaataagagatttatttgggcaaactataatggttgttggaaattgcaaatcttagtgtgaattattttagtccagttggtttctttctttctcttacctgaaatgaactatactgaggcaataggagctttgtatagtaatttaggagtgtaaaacaacttagggaaaaggattattaagcaggatgattgggatgacatcatgtgaaatttaggaattggaggcattgggaattgagagggtgctaacaaaggaaaacagcttattttagaatttgtctggaggatgtagaattgaagaagttttggtatttcttctgcagcggccccagtgcccttgaccaggaacatctcttggagtcagtagttttcatgaggctgacctaggaacttggccaacatatgcaacattgttctatttaaaatattccttgaattaaattcgatagtatcaatttaaaacataaagttttcactcaactcctttagaagttagattttagcttgtacttgtctttacctcttctgctgattatcagttgacaacactgagattactttcattttcctgtaagtcattatgaatttttctggtcaaccatgagttatcagtggaagcaataagtaggaagtactgtaaaagaattacaataaaataagagaaaccacttggagagcaagagggcttgtggacttgggggagcggttgtgagaaatgtctcagaacttaatttacaaataacattggtagattgacatgttgtctttcctataaagtaactttacctctgtcttaatagtaaactactatgaaagtgaattcgtgttcctcttgatttgtgaactgatgaaaattacaaaatgtggagttttttccccagataaagtaaatggtggaatattcaggtttatttgatacctagaaaatacctgaaattttccgtggtaataggcacattttgaaactgttttttttttctctgacaattgaatatattttatatatagttgattttgattattgaagactaaggaaaatttaagtttgaatgttagaaaatgaattttgcaaatttgaagtaattttattctttatgttttgggattgtagttatgttagatattcctcagttggggtaattgtcttgcatcattatctcttatcataatctgtttttcttcacacagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggagattaacacactgaaccgctacaagagggcaaagctgattttttttttaacttgaaaagattgcaaagggacattgaagtgtttaaaagagccatgtccaaacccatcttcatggatagctcagaggtatcctctttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgttttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagcctagaaaagaagcagtaatctacctctgccgataacctgtttaagatgactcagcagaacaccgcgtttcattctattggtcaattccatgtggctgactaggtcaattttttttctgaacaaaagcaggtttttatatgtaaacagtgagaaaagaaaggctaaacactatgtaaatgtgaatggaaacttggaaatactcgtttttataaactacaaaaactttttgttgtttatcaggaaatccatatttattttgtaattaactgtcaagcctgtggatgatttttttgaacttggtagttcataaaggtttacagtgaataaaaggatatcatcttgagtatagcaatatcaaaaggaattcagtagttactgctgtttaggaatataaggttaagatatcatatgggtcaggtcattttttttttctgtgctggttgccacatcttagcaagcaccaaaaaactaaagcagtttttaaaccgatatttacgtaaagaaaatcataaaatccaatgcttctgcatactgtgttatgttacagtccagttttgtgtgctttactacacagtttggttacaggacttctgtgcattgtaaacataaacagcatggaaaaggttaaatacctgtgttcagattgtaagatctagtccggacttgctgtgtatattgtaacgttaaatgaaaaaagaacccccctttgtattatagtcatgcggtcttatgtatgataaacagttgaataatttgtcctcagactctttactatgcttttttaaaaattaatttaagaaaaatgtaaacatagtaaaaatcttcctatgcaattaaactggtccaggtctggtaggtatagtatcaaagttgagttaaatgtgtaaaaaggaaactatttgagatacattgacataggcatcagcaatctctgaaagtaaaaattggaggtttaacagatcattttgatttttcacattgatttttttatttgaatgtttacataattttgtgattcaaaatgctcatattttagttggtagcatttcgactggatgtgagggtctgatggttttctctgatatgctttgacgtgcttggatgaaggaaggaatacgaatactcattcttccttccctaactcctcgtacggggccatatcagaattctagaattcttgccactgtgattcaattgctaacctaaagtcttctctttttacaaattcacctgcttcagtatatattaaggtggctttcgagaggcaagatgcttatttaaaagttaagcgtgaatctgtaaaattaaggttggttgcgtaaagttgaagttaaccacatgtaagaaaggaaaacttccattagttttcttcttagggtgtgagaattttacctaggcacatggatattgggctgaaaaaaaaaaaccgacatttttatttaaaactacatgtaaaaaatcatgaaagattcagtaattatgttaggctcacaagtgaccattgagtttgcccctgtactgcttcccagcttttgtggtgttgaacttttctgttcttccaatagggagatacataatcaaaatacacacgaagacgagatagcaggcactcagttctaggccagtttctcagtttcctttgggcctgcctttattttgatagtcgcagaatgcaggttcagatgcgatccggtgcattctgggtggtatccccatagacagaatacaagttcaagactcatttttatgtccatttttatagtggtagactgtatgtaatagaccagatggttcattccaaatacatgacttggtcttactgctatatatgaaggaagtttgaaaatgtaatggggacaaaagccgtgcgtgacttcggtatacccagacttcattcagatttcttaaaaatctgctagggatgtctgttgaccagacgttggaaaacctttggtgtcagggagagtagaggagaagttctgattttcataaccctggtttcttatctaggcctgtttccttgcgtgaaaacatacatcaccaagtaatttgtagtacaaagaacaagagaagaaaccctaagaagatagcttatttgttatcctcccttttaatgactaaccttaatccaaatgaatccactgagaaccagcctgtggatgcctactgggctttcaccctggaccaggaatttttgacgtatgcctgtgttgaaggcactggatgcttgttttgtggaagacatgttcattgaggtaagtggctcatcgcttggtgtgtttggctctctttggcattatgcatagccaaggtcccagattttggctgctctcagtgggtgttcttgcatcagaactttaaaaaaaataacactaccttaacactgagactgtcaggtatttgtcagtatttatttctaatttcctactttaaatcttaggagacaaagtgtttctccaactggacgctgatttgaaacacaactagaatgctacaggtctctcttccagtatgcagctgctgtacctgaaaatttttccccataatttcccatctttagggtatgtccctgttatcaggtgtggaattaatgtgggtaaatttccatttcagttgaatttcctgtcatccccagcaaaacctgtgaatccttcttcaaagcatagaggaggcagagacaagtcttaaaccggcttcccttcgcttttaccaggtagcctggttcagtcccagctgggtcctgaaggagcacagtactagagcctgagtcatgttgactattaataaagtgcattaagtttgggtcaggcaaagtggtggcaaaagttcatgatgcaggacagaggaaacaagtggacaagacaagtggagcccagctctgttcgcatgggaggccgggcgatgctggcatgggtgtggttggccgagttctcatagctagagaaaggccgtgtaggtataagtgcttaatgtttcatctgtctgaaagaccagctatttgataatcttcccgattaaatttctaaaattgcta

SEQ ID NO: 128281 - DNA, 5498 bp, Homo sapiens
  Payload ID: 5122
  Gene Symbol: DYRK1A
  Gene Name: dual-specificity tyrosine-(Y)-phosphorylation regulated kinase 1A
  Uniprot ID: Q13627
  ENST ID: ENST00000338785
  CDS Start-End: 230-1984
cgaggctgagactcaccggaggaagcggcgcgagcgccccgccatcgtcccggctgaagtgcagtggcacgatcataggtggtcactacagtctcagattcctgggcttaagcagtcttcccacctcagcctccccagtagctgggattacagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgagctcgcacgtggttcatttgcttgtgtcacctgccattctcaggtggagcagcactggatgccaggtgcctttagaatgaccgtatcatttaccctagaggttcatgacgttcctgtctaaggaaatgtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggagattaacacactgaaccgctacaagagggcaaagctgattttttttttaacttgaaaagattgcaaagggacattgaagtgtttaaaagagccatgtccaaacccatcttcatggatagctcagaggtatcctctttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgttttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagcctagaaaagaagcagtaatctacctctgccgataacctgtttaagatgactcagcagaacaccgcgtttcattctattggtcaattccatgtggctgactaggtcaattttttttctgaacaaaagcaggtttttatatgtaaacagtgagaaaagaaaggctaaacactatgtaaatgtgaatggaaacttggaaatactcgtttttataaactacaaaaactttttgttgtttatcaggaaatccatatttattttgtaattaactgtcaagcctgtggatgatttttttgaacttggtagttcataaaggtttacagtgaataaaaggatatcatcttgagtatagcaatatcaaaaggaattcagtagttactgctgtttaggaatataaggttaagatatcatatgggtcaggtcattttttttttctgtgctggttgccacatcttagcaagcaccaaaaaactaaagcagtttttaaaccgatatttacgtaaagaaaatcataaaatccaatgcttctgcatactgtgttatgttacagtccagttttgtgtgctttactacacagtttggttacaggacttctgtgcattgtaaacataaacagcatggaaaaggttaaatacctgtgttcagattgtaagatctagtccggacttgctgtgtatattgtaacgttaaatgaaaaaagaacccccctttgtattatagtcatgcggtcttatgtatgataaacagttgaataatttgtcctcagactctttactatgcttttttaaaaattaatttaagaaaaatgtaaacatagtaaaaatcttcctatgcaattaaactggtccaggtctggtaggtatagtatcaaagttgagttaaatgtgtaaaaaggaaactatttgagatacattgacataggcatcagcaatctctgaaagtaaaaattggaggtttaacagat

SEQ ID NO: 128282 - DNA, 1590 bp, Homo sapiens
  Payload ID: 5122
  Gene Symbol: DYRK1A
  Gene Name: dual-specificity tyrosine-(Y)-phosphorylation regulated kinase 1A
  Uniprot ID: Q13627
  ENST ID: ENST00000398956
  CDS Start-End: 1-1590
atgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtgcgtcagcaatttcctgctcctcttggttggtcaggcactga

SEQ ID NO: 128283 - DNA, 2422 bp, Homo sapiens
  Payload ID: 5122
  Gene Symbol: DYRK1A
  Gene Name: dual-specificity tyrosine-(Y)-phosphorylation regulated kinase 1A
  Uniprot ID: Q13627
  ENST ID: ENST00000398960
  CDS Start-End: 76-2367
gttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgtttttt

SEQ ID NO: 128284 - DNA, 338 bp, Homo sapiens
  Payload ID: 5122
  Gene Symbol: DYRK1A
  Gene Name: dual-specificity tyrosine-(Y)-phosphorylation regulated kinase 1A
  ENST ID: ENST00000455097
  CDS Start-End: 201-338
gctgagactcaccggaggaagcggcgcgagcgccccgccatcgtcccggatctcaccctgttgcccaggctggagtgcagtggcatgatcagggctcactgcagccttgacttcctggaatcagtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagcca

SEQ ID NO: 128285 - DNA, 519 bp, Homo sapiens
  Payload ID: 5122
  Gene Symbol: DYRK1A
  Gene Name: dual-specificity tyrosine-(Y)-phosphorylation regulated kinase 1A
  ENST ID: ENST00000426672
  CDS Start-End: 125-519
gctgagactcaccggaggaagcggcgcgagcgccccgccatcgtcccgtgttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaagga

SEQ ID NO: 128286 - DNA, 2448 bp, Homo sapiens
  Payload ID: 5123
  Gene Symbol: DYRK1B
  Gene Name: dual-specificity tyrosine-(Y)-phosphorylation regulated kinase 1B
  Uniprot ID: Q9Y463
  ENST ID: ENST00000348817
  CDS Start-End: 281-2086
gggatgggggcggagtccagggcgtgggggggccggtttgttgtggtcgccattttgctggttgcattactgggtaatcggggccctggcttgccgcgtccgccggataccctcagccagtgggcaggtctgagctcgggctccccgagcagtttgagtccccttgcccgctccttcaggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggattaccagggccccgggacacggcggctgcaggaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtgaccctgccccctccctggggcccctcctgaagccataccctcccccatctgggggccctgggctcccatcctcatctctctccttgactggaattgctgctacccagctggggtgggtgaggcctgcactgattggggcctggggcaggggggtcaaggagagggttttggccgctccctccccactaaggactggacccttgggcccctctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctc

SEQ ID NO: 128287 - DNA, 2535 bp, Homo sapiens
  Payload ID: 5123
  Gene Symbol: DYRK1B
  Gene Name: dual-specificity tyrosine-(Y)-phosphorylation regulated kinase 1B
  Uniprot ID: Q9Y463
  ENST ID: ENST00000323039
  CDS Start-End: 281-2170
gggatgggggcggagtccagggcgtgggggggccggtttgttgtggtcgccattttgctggttgcattactgggtaatcggggccctggcttgccgcgtccgccggataccctcagccagtgggcaggtctgagctcgggctccccgagcagtttgagtccccttgcccgctccttcaggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggattaccagggccccgggacacggcggctgcaggaggtgctgggcgtgcagacgggcgggcccgggggccggcgggcgggggagccgggccacagccccgccgactacctccgcttccaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtgaccctgccccctccctggggcccctcctgaagccataccctcccccatctgggggccctgggctcccatcctcatctctctccttgactggaattgctgctacccagctggggtgggtgaggcctgcactgattggggcctggggcaggggggtcaaggagagggttttggccgctccctccccactaaggactggacccttgggcccctctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctcaca

SEQ ID NO: 128288 - DNA, 2007 bp, Homo sapiens
  Payload ID: 5123
  Gene Symbol: DYRK1B
  Gene Name: dual-specificity tyrosine-(Y)-phosphorylation regulated kinase 1B
  Uniprot ID: Q9Y463
  ENST ID: ENST00000430012
  CDS Start-End: 238-2007
tggtcgccattttgctggttgcattactgggtaatcggggccctggcttgccgcgtccgccggataccctcagccagtgggcaggtctgagctcgggctccccgagcagtttgagtccccttgcccgctccttcaggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtga

SEQ ID NO: 128289 - DNA, 2724 bp, Homo sapiens
  Payload ID: 5123
  Gene Symbol: DYRK1B
  Gene Name: dual-specificity tyrosine-(Y)-phosphorylation regulated kinase 1B
  Uniprot ID: Q9Y463
  ENST ID: ENST00000593685
  CDS Start-End: 470-2359
ttccggtctcagcaggcccaggagggcctcctgggtggggggcgggacgccgggtccctaggggctggtggtcactcagggtggggcgtgtcgcccctcccccgtccacctgctctactcttcccccgcgtgccctgggctgacccttgtcccctcctctccccgcccccggtggcagtggcggctgctgttgtcacccaccgggcctcctgtcccgcttgccctccccgccgcggggccggccgggccagagacaggcggtcgccttttcagcgccgccaccgccgccatgctggccgctcgcccaccccactgggggccccaccgcgccccagccccccgtgggccccgcgccagccctgacccgggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggattaccagggccccgggacacggcggctgcaggaggtgctgggcgtgcagacgggcgggcccgggggccggcgggcgggggagccgggccacagccccgccgactacctccgcttccaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtgaccctgccccctccctggggcccctcctgaagccataccctcccccatctgggggccctgggctcccatcctcatctctctccttgactggaattgctgctacccagctggggtgggtgaggcctgcactgattggggcctggggcaggggggtcaaggagagggttttggccgctccctccccactaaggactggacccttgggcccctctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctcaca

SEQ ID NO: 128290 - DNA, 657 bp, Homo sapiens
  Payload ID: 5123
  Gene Symbol: DYRK1B
  Gene Name: dual-specificity tyrosine-(Y)-phosphorylation regulated kinase 1B
  ENST ID: ENST00000600611
  CDS Start-End: 140-657
cgccttccggtctcagcaggcccaggagggcctcctgggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatat

SEQ ID NO: 128291 - DNA, 772 bp, Homo sapiens
  Payload ID: 5123
  Gene Symbol: DYRK1B
  Gene Name: dual-specificity tyrosine-(Y)-phosphorylation regulated kinase 1B
  ENST ID: ENST00000601972
  CDS Start-End: 232-645
ccattttgctggttgcattactgggtaatcggggccctggcttgccgcgtccgccggataccctcagccagtgggcaggtctgagctcgggctccccgagcagtttgagtccccttgcccgctccttcaggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtgtgggacaccccccaccaccctgatccaaggccccactaacattgatcacacacccagtggttcagtggcttcaagtcccatgctgggccactcaccctagcccacttagtttccctgtgcctcagtcgccttttctgtaaaacagtttaaataacaagactcaaca

SEQ ID NO: 128292 - DNA, 1806 bp, Homo sapiens
  Payload ID: 5123
  Gene Symbol: DYRK1B
  Gene Name: dual-specificity tyrosine-(Y)-phosphorylation regulated kinase 1B
  Uniprot ID: Q9Y463
  ENST ID: ENST00000597639
  CDS Start-End: 1-1806
atggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggattaccagggccccgggacacggcggctgcaggaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtga

SEQ ID NO: 128293 - DNA, 2535 bp, Homo sapiens; identical to SEQ ID NO: 128287
  Payload ID: 5123
  Gene Symbol: DYRK1B
  Gene Name: dual-specificity tyrosine-(Y)-phosphorylation regulated kinase 1B
  Uniprot ID: Q9Y463
  ENST ID: ENST00000625757
  CDS Start-End: 281-2170

SEQ ID NO: 128294 - DNA, 772 bp, Homo sapiens; identical to SEQ ID NO: 128291
  Payload ID: 5123
  Gene Symbol: DYRK1B
  Gene Name: dual-specificity tyrosine-(Y)-phosphorylation regulated kinase 1B
  ENST ID: ENST00000630714
  CDS Start-End: 232-645

SEQ ID NO: 128295 - DNA, 2724 bp, Homo sapiens; identical to SEQ ID NO: 128289
  Payload ID: 5123
  Gene Symbol: DYRK1B
  Gene Name: dual-specificity tyrosine-(Y)-phosphorylation regulated kinase 1B
  Uniprot ID: Q9Y463
  ENST ID: ENST00000631090
  CDS Start-End: 470-2359

SEQ ID NO: 128296 - DNA, 2448 bp, Homo sapiens; identical to SEQ ID NO: 128286
  Payload ID: 5123
  Gene Symbol: DYRK1B
  Gene Name: dual-specificity tyrosine-(Y)-phosphorylation regulated kinase 1B
  Uniprot ID: Q9Y463
  ENST ID: ENST00000625388
  CDS Start-End: 281-2086

SEQ ID NO: 128297 - DNA, 657 bp, Homo sapiens; identical to SEQ ID NO: 128290
  Payload ID: 5123
  Gene Symbol: DYRK1B
  Gene Name: dual-specificity tyrosine-(Y)-phosphorylation regulated kinase 1B
  ENST ID: ENST00000626964
  CDS Start-End: 140-657

SEQ ID NO: 128298 - DNA, 1806 bp, Homo sapiens; identical to SEQ ID NO: 128292
  Payload ID: 5123
  Gene Symbol: DYRK1B
  Gene Name: dual-specificity tyrosine-(Y)-phosphorylation regulated kinase 1B
  Uniprot ID: Q9Y463
  ENST ID: ENST00000625438
  CDS Start-End: 1-1806

SEQ ID NO: 128299 - DNA, 2007 bp, Homo sapiens; identical to SEQ ID NO: 128288
  Payload ID: 5123
  Gene Symbol: DYRK1B
  Gene Name: dual-specificity tyrosine-(Y)-phosphorylation regulated kinase 1B
  Uniprot ID: Q9Y463
  ENST ID: ENST00000627034
  CDS Start-End: 238-2007

SEQ ID NO: 128300 - DNA, 566 bp, Homo sapiens
  Payload ID: 5124
  Gene Symbol: DYRK2
  Gene Name: dual-specificity tyrosine-(Y)-phosphorylation regulated kinase 2
  ENST ID: ENST00000319833
  CDS Start-End: 286-566
ttcctccgtctttctttggaagagggttgtcgctgcccagcggggttggagggggggtctgggtgactttctcccccctgaccctcttttgtctcctcccgcacgtggcttccaggccgaggtggggacagcgccgttcgtcagcttcaggcttccccggggctcggtgcaggggccacccggagcggagtggggactggcccgccctcccccatcgccctgccgcctctccgggccagcaacgctgccgccgcagcccacacgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaact

SEQ ID NO: 128301 - DNA, 8912 bp, Homo sapiens
  Payload ID: 5124
  Gene Symbol: DYRK2
  Gene Name: dual-specificity tyrosine-(Y)-phosphorylation regulated kinase 2
  Uniprot ID: Q92630
  ENST ID: ENST00000344096
  CDS Start-End: 414-2219
gtgtgtgagtgcgcgggggcgcgcgcgcgcgggcccgggagaggctcccgagccaggcggtcttcggtcctcgcagcgcttccagctccccgcgcccctatgtgagggagacggggaggcccgcggcgcgcaggggagggcgaggcatgtgcacgggccggagggtgctgcagccgcccgaggaagaggaggacggcggcgaggaggagagcggggggctcgcggcggcgggccccggccgaggggatgcagtggactgtgtgtgtctggctgtagcagacgcgaggcggcgacgaggcgccggggacccgcgcgaggggcggccgggaggcggcggcggcggccgccagaagtagcagcaggaccggcggcggcgacggcagccctgaaatgcattttcctctccagcggccatgttaaccaggaaaccttcggccgccgctcccgccgcctacccgaccggccgaggtggggacagcgccgttcgtcagcttcaggcttccccggggctcggtgcaggggccacccggagcggagtggggactggcccgccctcccccatcgccctgccgcctctccgggccagcaacgctgccgccgcagcccacacgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaagaagcgccagggcatgacaggtgggcccaacaatggtggctatgatgatgaccagggatcatatgtgcaggtgccccacgatcacgtggcttacaggtatgaggtcctcaaggtcattgggaaggggagctttgggcaggtggtcaaggcctacgatcacaaagtccaccagcacgtggccctaaagatggtgcggaatgagaagcgcttccaccggcaagcagcggaggagatccgaatcctggaacacctgcggaagcaggacaaggataacacaatgaatgtcatccatatgctggagaatttcaccttccgcaaccacatctgcatgacgtttgagctgctgagcatgaacctctatgagctcatcaagaagaataaattccagggcttcagtctgcctttggttcgcaagtttgcccactcgattctgcagtgcttggatgctttgcacaaaaacagaataattcactgtgaccttaagcccgagaacattttgttaaagcagcagggtagaagcggtattaaagtaattgattttggctccagttgttacgagcatcagcgtgtctacacgtacatccagtcgcgtttttaccgggctccagaagtgatccttggggccaggtatggcatgcccattgatatgtggagcctgggctgcattttagcagagctcctgacgggttaccccctcttgcctggggaagatgaaggggaccagctggcctgtatgattgaactgttgggcatgccctcacagaaactgctggatgcatccaaacgagccaaaaattttgtgagctccaagggttatccccgttactgcactgtcacgactctctcagatggctctgtggtcctaaacggaggccgttcccggagggggaaactgaggggcccaccggagagcagagagtgggggaacgcgctgaaggggtgtgatgatccccttttccttgacttcttaaaacagtgtttagagtgggatcctgcagtgcgcatgaccccaggccaggctttgcggcacccctggctgaggaggcggttgccaaagcctcccaccggggagaaaacgtcagtgaaaaggataactgagagcaccggtgctatcacatctatatccaagttacctccaccttctagctcagcttccaaactgaggactaatttggcgcagatgacagatgccaatgggaatattcagcagaggacagtgttgccaaaacttgttagctgagctcacgtcccctgatgctggtaacctgaaagatacgacattgctgagccttactgggttgaaaaggagtagctcagacctgtttttatttgctcaataactctactcatttgtatcttttcagcacttaattttaatgtaagaaagttgttcattttgtttttataaaatacatgaggacaatgctttaagtttttatactttcagaaactttttgtgttctaaaagtacaatgagccttactgtatttagtgtggcagaataataacatcagtggcaggccactgattacttcatgactgccacgcatttacagattggtgtcaaagacattcactatgtttttatggttcatgttatatcctccccagggtgacagccccttaaggccctccttttccctccatgctccaggtccatgcacaggtgtagcatgtcctgcttccgtttttcataaattaatctgggtgttgggggtagtgggaggagaacggtcagaatcaaagtgacattctaagaaaaactgtaccttagagattttcctctagtgctcaaacaaatacaaaataagatccccaaggtttaaactgcccagttagcattctgacattctaaaagccggcaaagcagcttttagtggataaatgggaatggaaacgtgtgtgttcctccaaattttctagtatgatcggtgagctgttttgtaaagaagcctcatattacagagttgcttttgcacctaaatttagaattgtattccatgaactgttcctcccttttctctgcttttctcctctctgttcctcttttaataccacacgtctgttgcttgcatttagtttgtcttcttccttcagctgtgtatcccagactgttaatacagaaaagagacatttcagctgtgattatgaccattgtttcatattccaattaaaaaaagaacagcagcctagctacttaaggtggggatttccatagttccaaagaagatttagcagattagagtgagttcacacttttcaggtgccactgtaaggttctctcagcctgggaaactatcaactctttctttaaaaagaaagagggttgaaaatcctctggacgaacagaagtcactttggctgttcagtaaggccaatgttaacaacacgtttagaggaggaaaagttcaacctcaagttaaatggtttgacttattcttcgtatcattagaagaaccccagagatagcattcctctattttattttactttcttttggattgcactgattgtttttgtgggaatgacactttatctggcaaagtaactgagagtttggtaaaagaatattttcttctctgaataataattattttcacagtgaaaatttcagtattttatcactaatgtatgagcaatgatctatatcaatttcaaggcacgtgaaaaaaattttttagtatgtgcaatttaatatagaaagatttctgcctgtttggacaataggttttgggtagtacagattaggataagtaagcttatatatgcacagagattattgtattacctgtaaattgatttacaagtacttaaaagcgtggtccccagtgaggccaagaaagtttccggttaagttctttaataataatcctacagtttatcttaagaaaaaaaaaaaggtttgaaaaaaacactttaatttaggcttcgttggttgatggtggaaaaaaatgctcaggaaatatttcagatatttgccaaaaaaccagtaataaggttaccttattaaaatagtgatatttgctttactatttaaggtgtcactgataaattaatttgtacttctgtgtttagaaattatagcttcttttcccttagtcaaattttttagcatattatacacatttctgtgtaatctgtggaagtgcaataatatgttagtaagttacattttaaataatgctcatgtgacaatactcccaatcaatggcttatagaatttaaagatctgtatattagattttggcttaaaggcatgagaagtataagacttggtttggtggctttgtaagaccaccagcctcttaatgatggttagcttctttaggtcattaaatcaataaaaacatataatgctgttttgctcttctaatgctcctcttccatttccagttatcttcacatttacatttaaatatacaaacctgagcctgccattattaatttccctataaaatgacgatacatgtgaacatttataaatggactaatactgcttgtctttcccccaccgcacaaaactggttcttaagatgccagcaatgaatttgagactatctttatttataaatggaaaccggaaacttttataccaaactataataatgtgcagcactgtagggcttttttttttttccctccaaatacagtgaaatttttttattcacaagagctgccacatctcagcatttagtaatagagctgctttaataaaattctagtttgattgtcatgtcaaaaaaagaaaaatgttgcatctttgtgattttaaaacataaattaatgaaggctctgataggctattaggagttggcttggaaacagtttttggtctcacaggttaccattgtttggggatgtctgagctgttttcagatctaggaatagcacagtgttgtcttgtctttggcagtctcatttggctctgtttcttgcaccaccagcgtgttcattaccacttaaatatattgctacagcagtggaacaacagagtggtgcaagacactgtagattaacggtagaggagaaattgtgcccttagtgttaacaatgtgccttttgttctgaatgccatgttgtagggcatgcattttttggcctctttaactcttcgaattctagtcagtaagaatggaacccatctctgcaaagatacatctgtcttaaatatctagttacaggccttaatagaaaccataaggcatgactcatcttcaggcactgaaaaaagataaccatcaggtagtgttacacaaggacttcctatatttaaggggttaaagatggtctttgttgtatcttaacatcagactgatttttacattttttttttgttatgctaacactagacaaaaatcaactgtatttgtaaaaatttacctcaaaccatttaattttatagtgtgattaatcccagggcatttggtatgaaccaaagtgcattccttttatatgtgcctggctctagtaaggatggccagggatttttacaatttgggtgcaaggcacttaagccacttttaaacttaatgggtggtttggggtcgtgttaaatgactccatcagaatgttagaaaacactttaggcatcagtagcattgggccatattggaatcctaaagtgtgaattattttaaggagagcattcatttttgtaatttttttcatcaaaaatatttctggtaagcagaagactttttaaaaaaactgatctggtctcggtaaaggttttaatattgcccaacataatgctgtaatagcattaaaaaaagtatttgtgaactctgtttcttaggggcttgtacatctctctgctatggacatacataaaattaattgtaattatactcagctcaactgctacagttctgtctaggcagtggcttgggtttttatcgagcaacaacttagacacgtgactgtaatatgctgcaactgtgtgtactgaaaatatgtgaaaatggttgaatgtggactgtgtatatatgtatgtaaaaatttctgtgagatgctgctgtcgccacttaacattaaatatgttctagtggattttaatcctagtggccagttctatgatactgtatgtattatacagctgatgacaggagtaagactgtttagtgaatatctgttaaattttattgttgtggccagagataatttcagaataaaattttaatgtcctaccttacttctctcccctttctaactataatttaactcctgatctatttctggtattatcctttgtcaattagcctggagagggtttagaatgcaaaatggatagctctatatcagggtcttgagaagttaaaataattcattctactagtttgttcatagcaatactttattagttcaatataagtatgcagattccaagtggaaaaacaaaggttttagtaagtagttcttgcttttcccaggatattctattccttcacctgtcagatttttatgttaacttttttatatatagcctctgctgtgttctttattatgctagagcttcatatcttcttttattttaaccttcacaatgatagttaagctgggggagcagaacctgtcaattattccccaccagtcttcattcttttctctgcacaagttctggtaaattattctaatgtgctctaaccagttccacccaatgttttttaatgcttatgagtttgcagtttttgtacttggtggtctctgtggttcacatttttttgtgttgtagtgtctcctgcctcggttggctcagaaaataaggcctaggaactgcaattagctcatgatttgtcaagttcagttagtaccaagctaagagtttacttacagatgacagcaagcagatgctctagtaattcgtcagacattgcagggatattgtgtagtcagatattaccctcttgtggaaagaactacctcacatcattatttatttcccttctgttaccaacagccaaggaattacttagtgtggctccctgcatcaatactgggatatgcttaaacaagggaatgccataagagttcccaattgcctcgtcatagcctgggccatagatttttgttactgctaatcttgcttcttaaagttcacacccagtgcaaaaaacccaatcagcaaactaaccccaaaatccaatatatttagaaatgtaagtgttaagagatgtgcattatgtacaaaattgaaaattggtgctaaagtggcaatgtcaatttaaaatttcttgtccagatctgactgactgactcaggagattatagttcctactcattctctttccttttatcagatctttcaaaagcgctttttaaaattgatcaatgtgcaattctgtttgagtctctacagtcctatcccttttggaatgaacagctacacaaataaatattcttggaacttcgaagttgtcttcaaactagctctagaaaatgtccctagttgacattagtgttggtctgttagaaggggaaattgatttgactgcttcatgttttgaaaagagcattaagagggatttgaggaaggtatatgtggctttctttttttttcttaagtttgaattacacttgatttcctttgggttattaggcagataaacccttgtcattagtaatacttagcactgtccaaaatgaaaaatgactgccagtgtgttgcacatacataagaaaattacatcttactgcgaagtctttggtttgtttccttatttggtttgactttgacttactattttgctatggtcatatccttaatatctgcggtacatttcatatatatatatggggtgggagcataattgccattcccatgtgtctcaaggaagcttaatgaggaaactaatgagttaatattaactcttctgaagaaagctgacattttaggagtattaagtcatctgtcgttaaggagcagcaagaatatattatgattgtatcacatgttccagaagagcattaccccttacatagaaagctccttggagatttcatgatgttggatgaacatcagtttatccttatacatccctatgagctataattatcctcatttgatacttgaggaaactgaagtgacttgctccaaagttgactacaaaaacattgcagtttgaggcttaggttgtaatcaggtaattttggtcttggacagtaagggaaaatccataatacataaaacacaaaagtttagaaagggggggaagttgagctagcaatgggcatttctattatttaagttacatatcagtttccaggaatatttttcaaatgggacaaactaaaaagttgaggactagagcatcgtagtgtctaagtgcacctaataacttaatgcatgtgcacacaccctcagttaatttgtaagagagtgacttctcattgttatttgtggagaggctaattatagtagcttcattctttattttctgtgttcttaaatttttttttacatttgaaagtatgaaaatactatttttgacactttactgatactcagggattaaaagttaaattttactgactgtagcagcaggtaaatctcttaaatttactcaggtttcctatcctttgcctccatatttaagaaaatatagaatgcctgccagggaaatatataaaaataaaaatttcaaatacaattttaaaataccaatttgtaaataaaccaattttacaaactaaaatattgtgtctttccttgctttttatcccaatttatctcccctcctaagtttgaggagttttatatattaaggctatttcttcatttgtaaaaatgaagtatgctatttgcaaagcaaaagcccatgaaaagccccaaatcatttaagtaaagcttactgaattgttttcaattgttttgggagaaatgtaactaattataagcaatttatgtggaccagcagcaaataaatgtatgagtaca

SEQ ID NO: 128302 - DNA, 2209 bp, Homo sapiens
  Payload ID: 5124
  Gene Symbol: DYRK2
  Gene Name: dual-specificity tyrosine-(Y)-phosphorylation regulated kinase 2
  Uniprot ID: Q92630
  ENST ID: ENST00000393555
  CDS Start-End: 427-2013
cggtcttcggtcctcgcagcgcttccagctccccgcgcccctatgtgagggagacggggaggcccgcggcgcgcaggggagggcgaggcatgtgcacgggccggagggtgctgcagccgcccgaggaagaggaggacggcggcgaggaggagagcggggggctcgcggcggcgggccccggccgaggggatgcagtggactgtgtgtgtctggctgtagcagacgcgaggcggcgacgaggcgccggggacccgcgcgaggggcggccgggaggcggcggcggcggccgccagaagtagcagcaggaccggcggcggcgacggcagccctgaaatgcattttcctctccagcggccatgttaaccaggaaaccttcggccgccgctcccgccgcctacccgaccgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaagaagcgccagggcatgacaggtgggcccaacaatggtggctatgatgatgaccagggatcatatgtgcaggtgccccacgatcacgtggcttacaggtatgaggtcctcaaggtcattgggaaggggagctttgggcaggtggtcaaggcctacgatcacaaagtccaccagcacgtggccctaaagatggtgcggaatgagaagcgcttccaccggcaagcagcggaggagatccgaatcctggaacacctgcggaagcaggacaaggataacacaatgaatgtcatccatatgctggagaatttcaccttccgcaaccacatctgcatgacgtttgagctgctgagcatgaacctctatgagctcatcaagaagaataaattccagggcttcagtctgcctttggttcgcaagtttgcccactcgattctgcagtgcttggatgctttgcacaaaaacagaataattcactgtgaccttaagcccgagaacattttgttaaagcagcagggtagaagcggtattaaagtaattgattttggctccagttgttacgagcatcagcgtgtctacacgtacatccagtcgcgtttttaccgggctccagaagtgatccttggggccaggtatggcatgcccattgatatgtggagcctgggctgcattttagcagagctcctgacgggttaccccctcttgcctggggaagatgaaggggaccagctggcctgtatgattgaactgttgggcatgccctcacagaaactgctggatgcatccaaacgagccaaaaattttgtgagctccaagggttatccccgttactgcactgtcacgactctctcagatggctctgtggtcctaaacggaggccgttcccggagggggaaactgaggggcccaccggagagcagagagtgggggaacgcgctgaaggggtgtgatgatccccttttccttgacttcttaaaacagtgtttagagtgggatcctgcagtgcgcatgaccccaggccaggctttgcggcacccctggctgaggaggcggttgccaaagcctcccaccggggagaaaacgtcagtgaaaaggataactgagagcaccggtgctatcacatctatatccaagttacctccaccttctagctcagcttccaaactgaggactaatttggcgcagatgacagatgccaatgggaatattcagcagaggacagtgttgccaaaacttgttagctgagctcacgtcccctgatgctggtaacctgaaagatacgacattgctgagccttactgggttgaaaaggagtagctcagacctgtttttatttgctcaataactctactcatttgtatcttttcagcacttaattttaatgtaagaaagttgttcattttgtttttataaaatacatgaggacaatgctttaagtttt

SEQ ID NO: 128303 - DNA, 568 bp, Homo sapiens
  Payload ID: 5124
  Gene Symbol: DYRK2
  Gene Name: dual-specificity tyrosine-(Y)-phosphorylation regulated kinase 2
  ENST ID: ENST00000543747
  CDS Start-End: 99-568
gaaaatgcatttatgtttaggggtgcgcatggcaggggaggggtctctgcggcgctttcggccggagggcagcagcgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaagaagcgccagggcatgacaggtgggcccaacaatggtggctatgatgatgaccagggatcatatgtgcaggtgccccacgatcacgtggcttacaggtatgaggtcctcaaggtcattgggaa

SEQ ID NO: 128304 - DNA, 560 bp, Homo sapiens
  Payload ID: 5124
  Gene Symbol: DYRK2
  Gene Name: dual-specificity tyrosine-(Y)-phosphorylation regulated kinase 2
  ENST ID: ENST00000542503
  CDS Start-End: 59-560
agatgaaacgacaagtctccactggagggagagcctgtggtgcaccagaaaaggaaggatgcgaatgtgcttctcagtactcctcataatggaggcctgtattttgctgtggcatatgccagatttacttgtttttaacgtgtgtgtaaacttcggtatgctgttaattattagatgcttgactttgaagattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaaga

SEQ ID NO: 128305 - DNA, 2329 bp, Homo sapiens
  Payload ID: 5125
  Gene Symbol: DYRK3
  Gene Name: dual-specificity tyrosine-(Y)-phosphorylation regulated kinase 3
  Uniprot ID: O43781
  ENST ID: ENST00000367106
  CDS Start-End: 474-2180
ggcgctggcaagcgaagcttgggggtggggaggaggtagagtgagccctcagtaggagggacgagggcaggggtctgactgcctccccgggaccgcccccacctcctctctatcagggccccctccccccatccctgtctcaccgggcgcgggggacggggctagagcggagttagagcaagaagaatttccacccctggattccctctgaaaccctagatcggggtatatgttaagggattacgaaaatctaggactttttgtggggctttttattaaagggggggagcccgggagcaataccttggaaagaagccctgttgcttagagcggataaccaacggctgaactcttggggtttgctgtgaggggtgcggtctagcttcgaatgtacagtggtggagccacagtgttaaagaacagagaagtgatccttaatcatttagaattttgcctccaccatccaccagaaaatgaagtggaaagagaagttgggggatggtgtctatgacaccttcatgatgatagatgaaaccaaatgtcccccctgttcaaatgtactctgcaatccttctgaaccacctccacccagaagactaaatatgaccactgagcagtttacaggagatcatactcagcactttttggatggaggtgagatgaaggtagaacagctgtttcaagaatttggcaacagaaaatccaatactattcagtcagatggcatcagtgactctgaaaaatgctctcctactgtttctcagggtaaaagttcagattgcttgaatacagtaaaatccaacagttcatccaaggcacccaaagtggtgcctctgactccagaacaagccctgaagcaatataaacaccacctcactgcctatgagaaactggaaataattaattatccagaaatttactttgtaggtccaaatgccaagaaaagacatggagttattggtggtcccaataatggagggtatgatgatgcagatggggcctatattcatgtacctcgagaccatctagcttatcgatatgaggtgctgaaaattattggcaaggggagttttgggcaggtggccagggtctatgatcacaaacttcgacagtacgtggccctaaaaatggtgcgcaatgagaagcgctttcatcgtcaagcagctgaggagatccggattttggagcatcttaagaaacaggataaaactggtagtatgaacgttatccacatgctggaaagtttcacattccggaaccatgtttgcatggcctttgaattgctgagcatagacctttatgagctgattaaaaaaaataagtttcagggttttagcgtccagttggtacgcaagtttgcccagtccatcttgcaatctttggatgccctccacaaaaataagattattcactgcgatctgaagccagaaaacattctcctgaaacaccacgggcgcagttcaaccaaggtcattgactttgggtccagctgtttcgagtaccagaagctctacacatatatccagtctcggttctacagagctccagaaatcatcttaggaagccgctacagcacaccaattgacatatggagttttggctgcatccttgcagaacttttaacaggacagcctctcttccctggagaggatgaaggagaccagttggcctgcatgatggagcttctagggatgccaccaccaaaacttctggagcaatccaaacgtgccaagtactttattaattccaagggcataccccgctactgctctgtgactacccaggcagatgggagggttgtgcttgtggggggtcgctcacgtaggggtaaaaagcggggtcccccaggcagcaaagactgggggacagcactgaaagggtgtgatgactacttgtttatagagttcttgaaaaggtgtcttcactgggacccctctgcccgcttgaccccagctcaagcattaagacacccttggattagcaagtctgtccccagacctctcaccaccatagacaaggtgtcagggaaacgggtagttaatcctgcaagtgctttccagggattgggttctaagctgcctccagttgttggaatagccaataagcttaaagctaacttaatgtcagaaaccaatggtagtatacccctatgcagtgtattgccaaaactgattagctagtggacagagatatgcccagagatgcatatgtgtatatttttatgatcttacaaacctgcaaatggaaaaaatgcaagcccattggtggatgtttttgttagagtagactttttttaaacaagacaaaacatttttatatgattataaaa

SEQ ID NO: 128306 - DNA, 2218 bp, Homo sapiens
  Payload ID: 5125
  Gene Symbol: DYRK3
  Gene Name: dual-specificity tyrosine-(Y)-phosphorylation regulated kinase 3
  Uniprot ID: O43781
  ENST ID: ENST00000367108
  CDS Start-End: 280-1986
gcagtgtctggtcgagagtacccgtgggagcgtcgcgccgcggaggcagccgtcccggcgtaggtggcgtggccgaccggacccccaactggcgcctctccccgcgcggggtcccgagctaggagatgggaggcacagctcgtgggcctgggcggaaggatgcggggccgcctggggccgggctcccgccccagcagcggagtggtggagccacagtgttaaagaacagagaagtgatccttaatcatttagaattttgcctccaccatccaccagaaaatgaagtggaaagagaagttgggggatggtgtctatgacaccttcatgatgatagatgaaaccaaatgtcccccctgttcaaatgtactctgcaatccttctgaaccacctccacccagaagactaaatatgaccactgagcagtttacaggagatcatactcagcactttttggatggaggtgagatgaaggtagaacagctgtttcaagaatttggcaacagaaaatccaatactattcagtcagatggcatcagtgactctgaaaaatgctctcctactgtttctcagggtaaaagttcagattgcttgaatacagtaaaatccaacagttcatccaaggcacccaaagtggtgcctctgactccagaacaagccctgaagcaatataaacaccacctcactgcctatgagaaactggaaataattaattatccagaaatttactttgtaggtccaaatgccaagaaaagacatggagttattggtggtcccaataatggagggtatgatgatgcagatggggcctatattcatgtacctcgagaccatctagcttatcgatatgaggtgctgaaaattattggcaaggggagttttgggcaggtggccagggtctatgatcacaaacttcgacagtacgtggccctaaaaatggtgcgcaatgagaagcgctttcatcgtcaagcagctgaggagatccggattttggagcatcttaagaaacaggataaaactggtagtatgaacgttatccacatgctggaaagtttcacattccggaaccatgtttgcatggcctttgaattgctgagcatagacctttatgagctgattaaaaaaaataagtttcagggttttagcgtccagttggtacgcaagtttgcccagtccatcttgcaatctttggatgccctccacaaaaataagattattcactgcgatctgaagccagaaaacattctcctgaaacaccacgggcgcagttcaaccaaggtcattgactttgggtccagctgtttcgagtaccagaagctctacacatatatccagtctcggttctacagagctccagaaatcatcttaggaagccgctacagcacaccaattgacatatggagttttggctgcatccttgcagaacttttaacaggacagcctctcttccctggagaggatgaaggagaccagttggcctgcatgatggagcttctagggatgccaccaccaaaacttctggagcaatccaaacgtgccaagtactttattaattccaagggcataccccgctactgctctgtgactacccaggcagatgggagggttgtgcttgtggggggtcgctcacgtaggggtaaaaagcggggtcccccaggcagcaaagactgggggacagcactgaaagggtgtgatgactacttgtttatagagttcttgaaaaggtgtcttcactgggacccctctgcccgcttgaccccagctcaagcattaagacacccttggattagcaagtctgtccccagacctctcaccaccatagacaaggtgtcagggaaacgggtagttaatcctgcaagtgctttccagggattgggttctaagctgcctccagttgttggaatagccaataagcttaaagctaacttaatgtcagaaaccaatggtagtatacccctatgcagtgtattgccaaaactgattagctagtggacagagatatgcccagagatgcatatgtgtatatttttatgatcttacaaacctgcaaatggaaaaaatgcaagcccattggtggatgtttttgttagagtagactttttttaaacaagacaaaacatttttatatgattataaaagaattcttcaagggctaattacctaaccagcttgtattggccatctggaatatgcattaaatgactttttataggtcaatgca

SEQ ID NO: 128307 - DNA, 2163 bp, Homo sapiens
  Payload ID: 5125
  Gene Symbol: DYRK3
  Gene Name: dual-specificity tyrosine-(Y)-phosphorylation regulated kinase 3
  Uniprot ID: O43781
  ENST ID: ENST00000367109
  CDS Start-End: 169-1935
acttcccagccggggccagtcgggagcgaaagtgcgctgagctgcagtgtctggtcgagagtacccgtgggagcgtcgcgccgcggaggcagccgtcccggcgtaggtggcgtggccgaccggacccccaactggcgcctctccccgcgcggggtcccgagctaggagatgggaggcacagctcgtgggcctgggcggaaggatgcggggccgcctggggccgggctcccgccccagcagcggaggttgggggatggtgtctatgacaccttcatgatgatagatgaaaccaaatgtcccccctgttcaaatgtactctgcaatccttctgaaccacctccacccagaagactaaatatgaccactgagcagtttacaggagatcatactcagcactttttggatggaggtgagatgaaggtagaacagctgtttcaagaatttggcaacagaaaatccaatactattcagtcagatggcatcagtgactctgaaaaatgctctcctactgtttctcagggtaaaagttcagattgcttgaatacagtaaaatccaacagttcatccaaggcacccaaagtggtgcctctgactccagaacaagccctgaagcaatataaacaccacctcactgcctatgagaaactggaaataattaattatccagaaatttactttgtaggtccaaatgccaagaaaagacatggagttattggtggtcccaataatggagggtatgatgatgcagatggggcctatattcatgtacctcgagaccatctagcttatcgatatgaggtgctgaaaattattggcaaggggagttttgggcaggtggccagggtctatgatcacaaacttcgacagtacgtggccctaaaaatggtgcgcaatgagaagcgctttcatcgtcaagcagctgaggagatccggattttggagcatcttaagaaacaggataaaactggtagtatgaacgttatccacatgctggaaagtttcacattccggaaccatgtttgcatggcctttgaattgctgagcatagacctttatgagctgattaaaaaaaataagtttcagggttttagcgtccagttggtacgcaagtttgcccagtccatcttgcaatctttggatgccctccacaaaaataagattattcactgcgatctgaagccagaaaacattctcctgaaacaccacgggcgcagttcaaccaaggtcattgactttgggtccagctgtttcgagtaccagaagctctacacatatatccagtctcggttctacagagctccagaaatcatcttaggaagccgctacagcacaccaattgacatatggagttttggctgcatccttgcagaacttttaacaggacagcctctcttccctggagaggatgaaggagaccagttggcctgcatgatggagcttctagggatgccaccaccaaaacttctggagcaatccaaacgtgccaagtactttattaattccaagggcataccccgctactgctctgtgactacccaggcagatgggagggttgtgcttgtggggggtcgctcacgtaggggtaaaaagcggggtcccccaggcagcaaagactgggggacagcactgaaagggtgtgatgactacttgtttatagagttcttgaaaaggtgtcttcactgggacccctctgcccgcttgaccccagctcaagcattaagacacccttggattagcaagtctgtccccagacctctcaccaccatagacaaggtgtcagggaaacgggtagttaatcctgcaagtgctttccagggattgggttctaagctgcctccagttgttggaatagccaataagcttaaagctaacttaatgtcagaaaccaatggtagtatacccctatgcagtgtattgccaaaactgattagctagtggacagagatatgcccagagatgcatatgtgtatatttttatgatcttacaaacctgcaaatggaaaaaatgcaagcccattggtggatgtttttgttagagtagactttttttaaacaagacaaaacatttttatatgattataaaagaattcttcaagggctaattacctaaccagcttgtattggccatctggaatatgcattaaatgactttttataggtcaa

SEQ ID NO: 128308 - DNA, 870 bp, Homo sapiens
  Payload ID: 5125
  Gene Symbol: DYRK3
  Gene Name: dual-specificity tyrosine-(Y)-phosphorylation regulated kinase 3
  ENST ID: ENST00000441486
  CDS Start-End: 140-870
agcggaggtaacggcgccacggggtaacgggctggaggcgccacagggagcggctggcgctgtggtggagccacagtgttaaagaacagagaagtgatccttaatcatttagaattttgcctccaccatccaccagaaaatgaagtggaaagagaagttgggggatggtgtctatgacaccttcatgatgatagatgaaaccaaatgtcccccctgttcaaatgtactctgcaatccttctgaaccacctccacccagaagactaaatatgaccactgagcagtttacaggagatcatactcagcactttttggatggaggtgagatgaaggtagaacagctgtttcaagaatttggcaacagaaaatccaatactattcagtcagatggcatcagtgactctgaaaaatgctctcctactgtttctcagggtaaaagttcagattgcttgaatacagtaaaatccaacagttcatccaaggcacccaaagtggtgcctctgactccagaacaagccctgaagcaatataaacaccacctcactgcctatgagaaactggaaataattaattatccagaaatttactttgtaggtccaaatgccaagaaaagacatggagttattggtggtcccaataatggagggtatgatgatgcagatggggcctatattcatgtacctcgagaccatctagcttatcgatatgaggtgctgaaaattattggcaaggggagttttgggcaggtggccagggtctatgatcacaaacttcgacagtacgtggccctaaaaatggtgcgcaatgagaagcgctttcatcgtcaagcagctgaggagatccggattttggagcatcttaagaaacagga

SEQ ID NO: 128309 - DNA, 1840 bp, Homo sapiens
  Payload ID: 5126
  Gene Symbol: DYRK4
  Gene Name: dual-specificity tyrosine-(Y)-phosphorylation regulated kinase 4
  Uniprot ID: Q9NR20
  ENST ID: ENST00000010132
  CDS Start-End: 143-1705
ccttctacagaacaccagtgttacttcactcccctttgtggacaccaaggggaagaagaatacggtaagcttcccacacattagcaagaaagtcctgctgaagtcatccctgctgtatcaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcagaggccctaaagctttttaagaaccagctgtctccatatgaacaaagtgaaatcctgggctacgcggagctgtggttcctgggtcttgaagccaagaagctcgacacggctcctgagaaatttagcaagacgagttttgatgatgagcatggcttctatctgaaggtcctgcatgatcacattgcctaccgctatgaagttctggagacaatcgggaaggggtcctttggacaggtggccaagtgcttggatcacaaaaacaatgagctggtggccctgaaaatcatcaggaacaagaagaggtttcaccagcaggccctgatggagctgaagatcctggaagctctcagaaagaaggacaaagacaacacctacaatgtggtgcatatgaaggactttttctactttcgcaatcacttctgcatcacctttgagctcctgggaatcaacttgtatgagttgatgaagaataacaactttcaaggcttcagtctgtccatagttcggcgcttcactctctctgttttgaagtgcttgcagatgctttcggtagagaaaatcattcactgtgatctcaagcccgaaaatatagtgctataccaaaagggccaagcctctgttaaagtcattgactttggatcaagctgttatgaacaccagaaagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggaggtgctgggtctgccgccagccggcttcattcagacagcctccaggagacagacattctttgattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagcagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaatacttcagactgttttttttaaatacataaaactttatgttaaaaaactctattaacatggccaa

SEQ ID NO: 128310 - DNA, 470 bp, Homo sapiens
  Payload ID: 5126
  Gene Symbol: DYRK4
  Gene Name: dual-specificity tyrosine-(Y)-phosphorylation regulated kinase 4
  ENST ID: ENST00000544671
  CDS Start-End: 1-361
ttccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaaggtacagcctgtcaaataaccagtcctagtcccacagtccgggaattaatattctagaattctgtaaatctccttgtgatatttttgaagccccagttctgtagtctggaaattaaaatctttgtttttaatattctgtttaatatgctgtttaagcatttctgaa

SEQ ID NO: 128311 - DNA, 989 bp, Homo sapiens
  Payload ID: 5126
  Gene Symbol: DYRK4
  Gene Name: dual-specificity tyrosine-(Y)-phosphorylation regulated kinase 4
  ENST ID: ENST00000539309
  CDS Start-End: 24-155
ggcgggcggtcagcgccggcctcatgcagctcctcccgccgcctatccgcaccggaacaaagcttaagtggagactcggcaaaagcaggaggccatttagtggaaaagttcaaaccgtggaaacaacaaatgaaaatgtcctttgtcttgcttgagcgatttgatcacctacatgtggtcgaatgcaaacggaatccctgcaaaccctgcactgccatactttctgccccaaagacagcccccagggcataaagatcaagctactggcaattgcagtagaaatcctaaaatcataacaggactcaaatggatgctaaaaagccaaggaaatgtgatttgactcccttcctggttttgaaagcaagaaagaaacaaaagttcacctctgcgaaggttggaagtaaactttcggttcagatccagaagccaccttccaatatcaagaactccagaatgacccaagtctttcataagaacaccagtgttacttcactcccctttgtggacaccaaggggaagaagaatacggtaagcttcccacacattagcaagaaagtcctgctgaagtcatccctgctgtatcagggaccaaataagataataggtgcgaaggtgccaactgaaagaggcgtcacacacacataagtccatgtgctcctgggcaagtcactttgtcttgttgggagctcaccttcttaagagcagcagtgaaaaactgttcccatctcttcccatagtgagatgttgctggggttgtcagcagcatacggtaaggtacaggggtctccccaggaatagtgtcagtcagacagatgcttcctttgggagagaggtagggagaaccttctgtctcttaatcgctgttttctccctggagaggtaggtaaagagcctggctgaaggtgggtgtctttggttaaataaatggtttatggcccccaggagagtcctaagtagttatttattgcaaacctcttttcctggacagg

SEQ ID NO: 128312 - DNA, 2068 bp, Homo sapiens
  Payload ID: 5126
  Gene Symbol: DYRK4
  Gene Name: dual-specificity tyrosine-(Y)-phosphorylation regulated kinase 4
  ENST ID: ENST00000543431
  CDS Start-End: 43-1947
tctcacagcctcccgcagcggcgggcggtcagcgccggcctcatgcagctcctcccgccgcctatccgcaccggaacaaagactcaaatggatgctaaaaagccaaggaaatgtgatttgactcccttcctggttttgaaagcaagaaagaaacaaaagttcacctctgcgaaggttggaagtaaactttcggttcagatccagaagccaccttccaatatcaagaactccagaatgacccaagtctttcataagaacaccagtgttacttcactcccctttgtggacaccaaggggaagaagaatacggtaagcttcccacacattagcaagaaagtcctgctgaagtcatccctgctgtatcaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcagaggccctaaagctttttaagaaccagctgtctccatatgaacaaagtgaaatcctgggctacgcggagctgtggttcctgggtcttgaagccaagaagctcgacacggctcctgagaaatttagcaagacgagttttgatgatgagcatggcttctatctgaaggtcctgcatgatcacattgcctaccgctatgaagttctggagacaatcgggaaggggtcctttggacaggtggccaagtgcttggatcacaaaaacaatgagctggtggccctgaaaatcatcaggaacaagaagaggtttcaccagcaggccctgatggagctgaagatcctggaagctctcagaaagaaggacaaagacaacacctacaatgtggtgcatatgaaggactttttctactttcgcaatcacttctgcatcacctttgagctcctgggaatcaacttgtatgagttgatgaagaataacaactttcaaggcttcagtctgtccatagttcggcgcttcactctctctgttttgaagtgcttgcagatgctttcggtagagaaaatcattcactgtgatctcaagcccgaaaatatagtgctataccaaaagggccaagcctctgttaaagtcattgactttggatcaagctgttatgaacaccagaaagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggaggtgctgggtctgccgccagccggcttcattcagacagcctccaggagacagacattctttgattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaatacttcagactgttttttttaaatacataaaactttatgttaaaaaactct

SEQ ID NO: 128313 - DNA, 3272 bp, Homo sapiens
  Payload ID: 5126
  Gene Symbol: DYRK4
  Gene Name: dual-specificity tyrosine-(Y)-phosphorylation regulated kinase 4
  Uniprot ID: Q9NR20
  ENST ID: ENST00000540757
  CDS Start-End: 161-1723
agtgtgagctgttgaaagcctgcagctaaacaccagtgttacttcactcccctttgtggacaccaaggggaagaagaatacggtaagcttcccacacattagcaagaaagtcctgctgaagtcatccctgctgtatcaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcagaggccctaaagctttttaagaaccagctgtctccatatgaacaaagtgaaatcctgggctacgcggagctgtggttcctgggtcttgaagccaagaagctcgacacggctcctgagaaatttagcaagacgagttttgatgatgagcatggcttctatctgaaggtcctgcatgatcacattgcctaccgctatgaagttctggagacaatcgggaaggggtcctttggacaggtggccaagtgcttggatcacaaaaacaatgagctggtggccctgaaaatcatcaggaacaagaagaggtttcaccagcaggccctgatggagctgaagatcctggaagctctcagaaagaaggacaaagacaacacctacaatgtggtgcatatgaaggactttttctactttcgcaatcacttctgcatcacctttgagctcctgggaatcaacttgtatgagttgatgaagaataacaactttcaaggcttcagtctgtccatagttcggcgcttcactctctctgttttgaagtgcttgcagatgctttcggtagagaaaatcattcactgtgatctcaagcccgaaaatatagtgctataccaaaagggccaagcctctgttaaagtcattgactttggatcaagctgttatgaacaccagaaagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggaggtgctgggtctgccgccagccggcttcattcagacagcctccaggagacagacattctttgattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagcagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaatacttcagactgttttttttaaatacataaaactttatgttaaaaaactctattaacatggccaattggcatgactcctcttatgagggatgggggaggatgtccttgcacttaaactcattccatatgcatctgtgtgtgtagagggggcgggtagttttgaactctcagtgttacagcatcattaatggaactccaaacaaaagaaattttttttcttcttgcccatgactgccaacctatgtcaggatttttgtttgaaaatgatagaagctgaattcaaaagcagtttaaacaacggaagacacttattgacttacataattggggcatcagaaaaggtagatgtagtttcaggcgcagcaggatccaggaattcaaatgaggttgtagggctcagactccctcttcatctattagccttgcttctcactatggttaacttcatcctgatgtcaggccctgctcagaagttaaccgccaacatccagtcaaaaagatacaggcttccttgctaacagggagtctccaaaatgattgtgacacagaaattgtgactgggatactgggatgcttggccagtctgggccccaagcccacagtgatggtgaaggcactgtgactgatgcttctctagactagagcaagggatggaaggtttcccaaaggaagggaagctaagtaaacaagcaggacatgttcactcatctaccatacgccaaatctaagtatgtcttcttacttccctttctaatcctcatctacacaaatacataatttttatgtggttgtcataggacagatagaattttacgtgaaacttaagatcataacatcagaaacaacatagagtatataaaaatagttttcttttttgcttgccatttggaataacctccccccagtacagttttcattttaattgttgcataatattttatgaagggggacaccaggtcattgaagcaatggatttggatgtaatctcccaggaaaaatcttgagttagaatagcagagggttgagagaaagtcccaggaaagacaaatatataaggagttgccagagttgaggaggtcctccaagagacccagagatacagaaagaaaattagaagccaatggagaagtttctagacagaaagaggagtcaagatagaaaattccacagaaaatccagggtaagaacagaaaatatttcttaagtggggtgatatggacattaagtcagagcagtgttagaacaggtaacttatcccagtttctatagccagaaagccacaaaaccagcaatagaactcagatccttgggaacattcttgaaacgatcttcaaccatggatgaagttggaggtggacactgttctgcagctctacagagaataagaagccaggtcttcaacattgtaatcaggatgattttgattgaataattcaaaagtatcttctgattttcatggttataaaaggttaaaatgaa

SEQ ID NO: 128314 - DNA, 945 bp, Homo sapiens
  Payload ID: 5126
  Gene Symbol: DYRK4
  Gene Name: dual-specificity tyrosine-(Y)-phosphorylation regulated kinase 4
  ENST ID: ENST00000539701
  CDS Start-End: 37-243
agcctcccgcagcggcgggcggtcagcgccggcctcatgcagctcctcccgccgcctatccgcaccggaacaaagactcaaatggatgctaaaaagccaaggaaatgtgatttgactcccttcctggttttgaaagcaagaaagaaacaaaagttcacctctgcgaagggccccactctttctgagatctacatggaagagacaaggaggagtcagctgagaaaacaggaaaatcgcctgtgaagtatgactgaggcgggatggtgtgatggaggtgtgcctttccgaaaaggctgggtggcctgaggcctgcagagagtccagttgctatcttccctgaacagtccaggttggaagtaaactttcggttcagatccagaagccaccttccaatatcaagaactccagaatgacccaagtctttcataagaacaccagtgttacttcactcccctttgtggacaccaaggggaagaagaatacggtaagcttcccacacattagcaagaaagtcctgctgaagtcatccctgctgtatcagggaccaaataagataataggtgcgaaggtgccaactgaaagaggcgtcacacacacataagtccatgtgctcctgggcaagtcactttgtcttgttgggagctcaccttcttaagagcagcagtgaaaaactgttcccatctcttcccatagtgagatgttgctggggttgtcagcagcatacggtaaggtacaggggtctccccaggaatagtgtcagtcagacagatgcttcctttgggagagaggtagggagaaccttctgtctcttaatcgctgttttctccctggagaggtaggtaaagagcctggctgaaggtgggtgtctttggttaaataaatggtttatggcccccaggagagtcctaagtagttatttattgcaaacctcttttcctggacagg

SEQ ID NO: 128315 - DNA, 454 bp, Homo sapiens
  Payload ID: 5126
  Gene Symbol: DYRK4
  Gene Name: dual-specificity tyrosine-(Y)-phosphorylation regulated kinase 4
  ENST ID: ENST00000537719
  CDS Start-End: 33-212
tcccgcagcggcgggcggtcagcgccggcctcatgcagctcctcccgccgcctatccgcaccggaacaaagactcaaatggatgctaaaaagccaaggaaatgtgatttgactcccttcctggttttgaaagcaagaaagaaacaaaagttcacctctgcgaaggaagagacaaggaggagtcagctgagaaaacaggaaaatcgcctgtgaagtatgactgaggcgggatggtgtgatggaggtgtgcctttccgaaaaggctgggtggcctgaggcctgcagagagtccagttgctatcttccctgaacagtccaggttggaagtaaactttcggttcagatccagaagccaccttccaatatcaagaactccagaatgacccaagtctttcataagaacaccagtgttacttcactcccctttgtggacaccaaggggaagaagaatacgg

SEQ ID NO: 128316 - DNA, 5049 bp, Homo sapiens
  Payload ID: 5127
  Gene Symbol: DYM
  Gene Name: dymeclin
  Uniprot ID: Q7RTS9
  ENST ID: ENST00000269445
  CDS Start-End: 459-2468
gctttgcggtagcccaggaggtactaggagggcggaggcacgaataacacccaaaggactacagtttccagaagcccgcgcgcgccgcgtgccacgtgaccacctggctggcgcgcgcgcctgggggtctggtccctagccgcgttctcggtcgcttccctcttctctcgccgcctcctggcctccgcaccgacgcggcccgggctggagccgagccggggccgagctgcaggccggaccggagccggatctgtacccgctgagacgtggaaacatggaggcctgagccggtgtgcgccacctgggctgcggcggcgacagcgacttctcctgacccctctgccaccctcccatccgtccgcgggtccgtggagctggagcagatcccccagccggctgagacaggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagtagtgagttgaaactcttggaggaagcaaccatttcagtctgcaggtcattagttgaaaacaatcctcgaacaggaaatcttggtgcactaattaaggtcttcctttctagaaccaaagaactaaaactttcagcagaatgtcagaaccacatcttcatttggcagacacacaatgctttgtttattatttgctgtttgctgaaagtgttcatctgtcagatgtcagaggaggaattacaacttcattttacttatgaagaaaaatctcctggcaattacagttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaacaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtccttcaagaacacacaagatagcagtcctttcccctcatcaattccacatgccttccagatcaactttaatagtttgtacacagctctttgtgaacagcagacatctgatcaagcaactctcctcttgtataccttgctccatcaaaatagtaatattagaacatacatgttggctcgcacagatatggaaaatcttgttttaccaattcttgagattctgtatcatgttgaagaaaggaattcacaccatgtgtatatggcccttataatattgttgatccttacggaagatgatggcttcaacagatccattcatgaagtgatactaaaaaatattacttggtattcagaacgagttttaactgaaatctccttggggagtctcctgatcctggtggtaataagaaccattcaatacaacatgactaggacacgagacaagtaccttcacacaaattgtttggcagctttagcaaatatgtcggcacagtttcgttctctccatcagtatgctgcccagaggatcatcagtttattttctttgctgtctaaaaaacacaacaaagttctggaacaagccacacagtccttgagaggttcgctgagttctaatgatgttcctctaccagattatgcacaagacctaaatgtcattgaagaagtgattcgaatgatgttagagatcatcaactcctgcctgacaaattcccttcaccacaacccaaacttggtatacgccctgctttacaaacgcgatctctttgaacaatttcgaactcatccttcatttcaggatataatgcaaaatattgatctggtgatctccttctttagctcaaggttgctgcaagctggagctgagctgtcagtggaacgggtcctggaaatcattaagcaaggcgtcgttgcgctgcccaaagacagactgaagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgctattcaacatgcagttttatttcgaagccaaaaatctagagctttcccaagatcctgttgccttaggcacatcacacttcaacagtgcacactatccaacagtgcacactattcaacagtgcacactattcaaaagcgtagactatttttttgcatgttcaagatatttgttttggtcttatgtgtgtgtgagagagagagattcctttgacattaaggagcatcaatgagaaaagatgatgaggcaggaattaataaagaaatgaagtcgtgtgtgtttggttgcctgtcagagggcacacaatttcataaacaccatgcctggacaatttgatattaatatttaacacctctgcatcttttcttaaaaaagaatatgggccagatacagtggctcacatttgtaatcccagcactttggggagccaagttagcagaatcccttgagcacaggaatctgaaaccagcttgggcaacatagtgagatcccatctctacaaaaaacttaaaaattagccaggcatgatggcacattcctgtagtcctagctactcaggaggctaaggtaggaggattgcctgagcccaggagttcaaggctgcagtgagctaagaacgtgccagtacactccagcctgagccacaaagtgagaccctgtctcgcaaaaaaaaaaaaagaaagaaaagaaaaagaaaatggctacttctcatgaagcccagattaacttttctgtgaatatggcctgtgaactgttgctggaattaaattggagtctagcacaaattaagttaatctactctgtattaatcattgggaaaaagaaaagcttcatttgaaaacagtctttttccttcacccacactaatagaaaaaggagagtaatttgttcatactgtattccacgtgggatgaaaagcatgttttgctctttgtttctgggccggtgtgatccgtgtgttggtgcctgagctggaggaaggagcttcttgcagggaaacagccactggggccacattgagggccagttgggaccttcctttccagtcacactctgtgtcctcacgggccccttcacagtctagataaggagcctagtttcattctcaaagaaaaagtatttggtcttcaacatagaaagcacaaaagcccagacgagactgagcacactgttcgaatccactgccagctcatctgtgtcagggctggcttctcctgtcctgtgtcccagggctgcaggcccgtgttatttgagtccatcaaatcttccgagggcctcggaggaaccattctcagtcaccccaagctctgtaaaaggtcaaaacactggcagcctctcagtgcaccactgtgtgggctccacacgggaaggcctggccaagctgtgctcttagaggctgtcgaggtagggcaggaagcttccctatcctcgtctggatggaatgaaacagaggttccctaaggccaagggactcgtggagcgcccatcccgggtggggtcccagaggtgagtgcagcttgcctcctgtccccaaggggcttgttctgtcaggcctcctccagtcactgctggagtggggactctgactcctgtgttcacctcagagcccatgtacaggctagaggtgaggcttggcaacaacttctactaatacttagctttgtggcagagccagtctgaaggaggagaagcgctctcagccagcagggggagtgatgattatcatttcaggtagcaaggatatgtatttactatgtggggaaataatttgcaactttaatttgtttccaaagcattttgattggcttccttttcctttaaaccaaaaaattgtttaaatgtttaagggtcatgtggaacagctgagcttctggcaggaccacagaactgtcctctgagtctgagggctgggcagtgccacaggacagtccctgggctgcaggactgtcagtgcttgttgtgtgaggaaatgaggcccttcaaaaacccagtcatcttgacagagggcacactcccaaggaaggcctgactggggaatcatacagcctctcctccaggcctctgggctcactgaggtgcccccagaaccctgattgccctcccctctttcccttttctcattcatcacacagtagaagcactcactagctaacagctcagctggggcagcagcctccatggaggcctgcaagtgatgctcccagtcctggttcccgctcaggagggaggccccaccacgtgcatcactgcctcagctctgcaaagtcaccagaggcttcttcctgatttttgtgaaagatttattatatggcaataaatctgaatgataaactttca

SEQ ID NO: 128317 - DNA, 2147 bp, Homo sapiens
  Payload ID: 5127
  Gene Symbol: DYM
  Gene Name: dymeclin
  Uniprot ID: Q7RTS9
  ENST ID: ENST00000442713
  CDS Start-End: 322-1761
agccgcgttctcggtcgcttccctcttctctcgccgcctcctggcctccgcaccgacgcggcccgggctggagccgagccggggccgagctgcaggccggaccggagccggatctgtacccgctgagacgtggaaacatggaggcctgagccggtgtgcgccacctgggctgcggcggcgacagcgacttctcctgacccctctgccaccctcccatccgtccgcgggtccgtggagctggagcagatcccccagccggctgagacaggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagtagtgagttgaaactcttggaggaagcaaccatttcagtctgcaggtcattagcaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtccttcaagaacacacaagatagcagtcctttcccctcatcaattccacatgccttccagatcaactttaatagtttgtacacagctctttgtgaacagcagacatctgatcaagcaactctcctcttgtataccttgctccatcaaaatagtaatattagaacatacatgttggctcgcacagatatggaaaatcttgttttaccaattcttgagattctgtatcatgttgaagaaaggaattcacaccatgtgtatatggcccttataatattgttgatccttacggaagatgatggcttcaacagatccattcatgaagtgatactaaaaaatattacttggtattcagaacgagttttaactgaaatctccttggggagtctcctgatcctggtggtaataagaaccattcaatacaacatgactaggacacgagacaagtaccttcacacaaattgtttggcagctttagcaaatatgtcggcacagtttcgttctctccatcagtatgctgcccagaggatcatcagtttattttctttgctgtctaaaaaacacaacaaagttctggaacaagccacacagtccttgagaggttcgctgagttctaatgatgttcctctaccagattatgcacaagacctaaatgtcattgaagaagtgattcgaatgatgttagagatcatcaactcctgcctgacaaattcccttcaccacaacccaaacttggtatacgccctgctttacaaacgcgatctctttgaacaatttcgaactcatccttcatttcaggatataatgcaaaatattgatctggtgatctccttctttagctcaaggttgctgcaagctggagctgagctgtcagtggaacgggtcctggaaatcattaagcaaggcgtcgttgcgctgcccaaagacagactgaagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgctattcaacatgcagttttatttcgaagccaaaaatctagagctttcccaagatcctgttgccttaggcacatcacacttcaacagtgcacactatccaacagtgcacactattcaacagtgcacactattcaaaagcgta

SEQ ID NO: 128318 - DNA, 961 bp, Homo sapiens
  Payload ID: 5127
  Gene Symbol: DYM
  Gene Name: dymeclin
  ENST ID: ENST00000418472
  CDS Start-End: 176-295
agttttgtgaatgatttctgtaattctctttgctaagtagtgagttgaaactcttggaggaagcaaccatttcagtctgcaggtcattagttgaaaacaatcctcgaacaggaaatcttggtgcactaattaaggtcttcctttctagaaccaaagaactaaaactttcagcagaatgtcagaaccacatcttcatttggcagacacacaatgctttgtttattatttgctgtttgctgaaagtgttcatctgtcagatgtcagaggaggaattacaacttcattttacttatgaagaaaaatctcctggcaattacagttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaaagtgccttgttgtagaaaaccttacagttccggagtgaaatttgttgtcactgacagggcaggaggagaatccttgtactggaactgcggctggatgagtagtgaaccacttgcttggaccctcctatgagtcaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtcctt

SEQ ID NO: 128319 - DNA, 568 bp, Homo sapiens
  Payload ID: 5127
  Gene Symbol: DYM
  Gene Name: dymeclin
  ENST ID: ENST00000584983
  CDS Start-End: 80-568
agatggctcaggtgcttcggctgccacggcagcaggttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaacaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtccttcaagaacacacaagatagcagt

SEQ ID NO: 128320 - DNA, 568 bp, Homo sapiens
  Payload ID: 5127
  Gene Symbol: DYM
  Gene Name: dymeclin
  ENST ID: ENST00000583280
  CDS Start-End: 151-568
cagatggctcaggtgcttcggctgccacggcagcaggttctctgctctcttttctctgctggaactgggccctagagactggggcaggcggtaggtagctcaggaggttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaacaggactctggactgtcttcacactaggtggtgtgggcagcaaagcggctgcctctccagagctttcttcccctctggccaaccagagtctcctgcttctgctggtgttggccaatctga

SEQ ID NO: 128321 - DNA, 366 bp, Homo sapiens
  Payload ID: 5127
  Gene Symbol: DYM
  Gene Name: dymeclin
  ENST ID: ENST00000582399
  CDS Start-End: 1-366
ccattcaatacaacatgactaggacacgagacaagtaccttcacacaaattgtttggcagctttagcaaatatgtcggcacagtttcgttctctccatcagtatgctgcccagaggatcatcagttatacctgccgccacttgcggagatatgtttatgtgttggacaaactgtatttcccccactctcactgttctacgcttcagcattgcttctcgaccctcagtgacaatggagaggaactcttgtctttaacttgctctcacattctcagatcctatgcttccagtttattttctttgctgtctaaaaaacacaacaaagttctggaacaagccacacagtccttgagaggttcgctgagtt

SEQ ID NO: 128322 - DNA, 869 bp, Homo sapiens
  Payload ID: 5127
  Gene Symbol: DYM
  Gene Name: dymeclin
  ENST ID: ENST00000579058
  CDS Start-End: 284-508
tcctggcctccgcaccgacgcggcccgggctggagccgagccggggccgagctgcaggccggaccggagccggatctgtacccgctgagacgtggaaacatggaggcctgagccggtgtgcgccacctgggctgcggcggcgacagcgacttctcctgacccctctgccaccctcccatccgtccgcgggtccgtggagctggagcagatcccccagccggctgagacaggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagacagagtttcactcttgttgcccaggctggagtgcaatggcatgatctcggctcaccacaacctctgcctcccgggattaagtgattctcctgcctcagcctccccagtagctgggattacaggctggagtgcaatggtgccatctcagctcaccgcaatctctgcctcctgcattcaagtgattctcctgcctcagcctcccgagtagctgaaattacagtagtgagttgaaactcttggaggaagcaaccatttcagtctgcaggtcattagttgaaaacaatcctcgaacaggaaatcttggtgcactaattaaggtcttcctttctagaaccaaagaactaaaactttcagcagaatgtcagaaccacatcttcatttggcagacacacaatgctttgtttattatttgctgtttgctgaaagtgttcatctgtcagatgtc

SEQ ID NO: 128323 - DNA, 755 bp, Homo sapiens
  Payload ID: 5127
  Gene Symbol: DYM
  Gene Name: dymeclin
  ENST ID: ENST00000578396
  CDS Start-End: 205-555
gctgaaagtgttcatctgtcagatgtcagaggaggaattacaacttcattttacttatgaagaaaaatctcctggcaattacaacacatccaggaacagtactttgcatctttcaatccgatcaagttgacactcgatattaaccatcacagtatctcaggttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaaatttgaagggaagactgatggcctctttcatgctacaaatagttgaagaatgaattagtttgtatttacaaggaggaatatagaataaagcaatcaattgcagatgaaatcctgggataagtttctgagacttgctacaagtgccatttatttggtgctaatgatttaatctatttttgagactgagttgtaaattgtagaatttaaaaatatttaaaagtgagaatattaaaattgaaattatggaattcta

SEQ ID NO: 128324 - DNA, 554 bp, Homo sapiens
  Payload ID: 5127
  Gene Symbol: DYM
  Gene Name: dymeclin
  ENST ID: ENST00000583353
  CDS Start-End: 226-554
ttttgctatttctcaattctccagaatcccacacaatattgcttgactttgggatggttattcagctgcaattaacagaggccttaataaggttaagccgccagaacgagcggtgtagcatgagcgaggactctagcacctggcaggtgaggttgactctagcacccggcaggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagtagtgagttgaaactcttggaggaagcaaccatttcagtctgcaggtcattagttgaaaacaatcctcgaacaggaaatcttggtgcactaattaaggtcttcctttctagaaccaaagaactaaaactttcagcagaatgtcagaaccacatcttcatttggcagacacacaatgctttgtttattat

SEQ ID NO: 128325 - DNA, 588 bp, Homo sapiens
  Payload ID: 5127
  Gene Symbol: DYM
  Gene Name: dymeclin
  ENST ID: ENST00000577734
  CDS Start-End: 1-203
ggttgctgcaagctggagctgagctgtcagtggaacgggtcctggaaatcattaagcaaggcgtcgttgcgctgcccaaagacagactgaagccgctggccgatcgtcaggtggacagagtccttgcatgccaggcctttgtgtatgcagcttctgggttctcacagtttcatggcttgtctgtcagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgctattc

SEQ ID NO: 128326 - DNA, 566 bp, Homo sapiens
  Payload ID: 5127
  Gene Symbol: DYM
  Gene Name: dymeclin
  ENST ID: ENST00000581738
  CDS Start-End: 141-566
tttttccagatggctcaggtgcttcggctgccacggcagcaggttctctgctctcttttctctgctggaactgggccctagagactggggcaggcggttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaacaggactctggactgtcttcacactaggtggtgtgggcagcaaagcggctgcctctccagagctttcttcccctctggccaaccagagtctcctgcttctgctggtgttggccaatctgacagatgcc

SEQ ID NO: 128327 - DNA, 564 bp, Homo sapiens
  Payload ID: 5127
  Gene Symbol: DYM
  Gene Name: dymeclin
  ENST ID: ENST00000583225
  CDS Start-End: 141-564
aggtgcttcggctgccacggcagcaggttctctgctctcttttctctgctggaactgggccctagagactggggcaggcggtaggtagctcaggaggttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaagactctggactgtcttcacactaggtggtgtgggcagcaaagcggctgcctctccagagctttcttcccctctggccaaccagagtctcctgcttctgctggtgttggccaatctgacagatgcct

SEQ ID NO: 128328 - DNA, 4500 bp, Homo sapiens
  Payload ID: 5128
  Gene Symbol: DCTN1
  Gene Name: dynactin 1
  Uniprot ID: Q14203
  ENST ID: ENST00000361874
  CDS Start-End: 319-4155
agaggctagcacggttcctgacaagtctagagcagcactagcgcagagtgagactcatcagctggcaagcaggattctgtgtctctgggttcaggaatcctcaggcagcagaggggacttgctcctcagcccccatcactgcccccacccctacccgtgtaggccaccgagtgaggcccatggactggggagggctgtgcctgacgactcctgtgtccctctatgagggcccagcgccctgaccctcctgcctaggtttctaccttttctctctgtctttggccagctgggggagggggtagaggccgggtgagcaacatggcacagagcaagaggcacgtgtacagccggacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcggggactgaagcctaagaaggcaccgacagcccgaaagaccacaactcggcgacccaagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtgaagaacagcagcgaggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgc

SEQ ID NO: 128329 - DNA, 4479 bp, Homo sapiens
  Payload ID: 5128
  Gene Symbol: DCTN1
  Gene Name: dynactin 1
  Uniprot ID: Q14203
  ENST ID: ENST00000394003
  CDS Start-End: 319-4134
agaggctagcacggttcctgacaagtctagagcagcactagcgcagagtgagactcatcagctggcaagcaggattctgtgtctctgggttcaggaatcctcaggcagcagaggggacttgctcctcagcccccatcactgcccccacccctacccgtgtaggccaccgagtgaggcccatggactggggagggctgtgcctgacgactcctgtgtccctctatgagggcccagcgccctgaccctcctgcctaggtttctaccttttctctctgtctttggccagctgggggagggggtagaggccgggtgagcaacatggcacagagcaagaggcacgtgtacagccggacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactggcaccgacagcccgaaagaccacaactcggcgacccaagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtgaagaacagcagcgaggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgc

SEQ ID NO: 128330 - DNA, 4365 bp, Homo sapiens
  Payload ID: 5128
  Gene Symbol: DCTN1
  Gene Name: dynactin 1
  Uniprot ID: Q14203
  ENST ID: ENST00000409240
  CDS Start-End: 313-4023
acagtgcgcgtgcgcttatcctgtcccaggtgtccagctttgtgcctgattgatgtaatcccggctgcggtcggtgcgcagttttcagtcagggctggactgcgggaaaagagggttcactcgacccagaacgcctctgggcctctgggccgaagggttctgggcggtcctggaagggtctggcggcgagtcgggcagcccacgagggcggggagggcggggccggccccgcagggtcttgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcag

SEQ ID NO: 128331 - DNA, 4024 bp, Homo sapiens
  Payload ID: 5128
  Gene Symbol: DCTN1
  Gene Name: dynactin 1
  Uniprot ID: Q14203
  ENST ID: ENST00000409567
  CDS Start-End: 263-4024
atcagctggcaagcaggattctgtgtctctgggttcaggaatcctcaggcagcagaggggacttgctcctcagcccccatcactgcccccacccctacccgtgtaggccaccgagtgaggcccatggactggggagggctgtgcctgacgactcctgtgtccctctatgagggcccagcgccctgaccctcctgcctaggtttctaccttttctctctgtctttggccagctgggggagggggtagaggccgggtgagcaacatggcacagagcaagaggcacgtgtacagccggacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaa

SEQ ID NO: 128332 - DNA, 4145 bp, Homo sapiens
  Payload ID: 5128
  Gene Symbol: DCTN1
  Gene Name: dynactin 1
  Uniprot ID: Q14203
  ENST ID: ENST00000409438
  CDS Start-End: 384-3803
agtggctccacccccatggagcagaggagggtgggtgcatgacgtcaggtggagctggtgctgcggccactgaggctgccatcagcctaagctggtgaactgggccaggcaccgctccggtgcctgccggagcctggcgatccagctgcacgtctgcgggggcctctgtgtcagagcggcggccgtttgcaggctgggaagctgccgcaccgggaggctgagactgcattgttgggatttgatgcactaatctcctgtctccgccgcctttccctctgttcggtctcttgccctccctcccttcgtctgtccttcctccgtgtgtttgtctatcctcctctgtccctcctctttcctctccttgctttctttggttttctgcaatgatgagacaggcaccgacagcccgaaagaccacaactcggcgacccaagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcag

SEQ ID NO: 128333 - DNA, 4202 bp, Homo sapiens
  Payload ID: 5128
  Gene Symbol: DCTN1
  Gene Name: dynactin 1
  ENST ID: ENST00000409868
  CDS Start-End: 91-3861
ccggccccgcagggtcttgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcggggactgaagcctaagaaggcaccgacagcccgaaagaccacaactcggcgacccaagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttca

SEQ ID NO: 128334 - DNA, 598 bp, Homo sapiens
  Payload ID: 5128
  Gene Symbol: DCTN1
  Gene Name: dynactin 1
  ENST ID: ENST00000437375
  CDS Start-End: 337-598
agtgcaggtacggaggcgcgactctgccaaccgtctgctccgccggccccctacgtgttcgtgaggttgccggcggtgggctggggaccgagcccggtgtgcggggcggggactggcaggggtgggcgcttgtcggggtccgggggctccgcctgagcgtttgccccgaggccggtctgacccacctcagctcttcagcctagcattgttctcctgggatcagagtgactgcgccttagagttcctccagaactgcaagggtctcccctccgttcctgcgagcgtctgaggcgcccctgaatccatactgagctacagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactactt

SEQ ID NO: 128335 - DNA, 521 bp, Homo sapiens
  Payload ID: 5128
  Gene Symbol: DCTN1
  Gene Name: dynactin 1
  ENST ID: ENST00000440727
  CDS Start-End: 330-521
gatgtaatcccggctgcggtcggtgcgcagttttcagtcagggctggactgcgggaaaagagggttcactcgacccagaacgcctctgggcctctgggccgaagggttctgggcggtcctggaagggtctggcggcgagtcgggcagcccacgagggcggggagggcggggccggccccgcagggtcttgggcgtcggtcgtcggtggggtcggagctgggcgcggagcccctcacagtgcagcaacatagcatggagaagaatctccagagcttggggatagagagttgaccaaacaagactcaggccagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgt

SEQ ID NO: 128336 - DNA, 556 bp, Homo sapiens
  Payload ID: 5128
  Gene Symbol: DCTN1
  Gene Name: dynactin 1
  ENST ID: ENST00000417090
  CDS Start-End: 152-556
gtcggtcgtcggtggggtcggagctgggcgcggagcccctcacagtgcagttcccaggtgatgctaatgctgctggcccatggaacacaatctgagtagcaaaagtatagatcactggattgaaagttagagaccatgttttccagaacagatgtgctgccttgagagagtcactttatctgtccaggcctataagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactg

SEQ ID NO: 128337 - DNA, 627 bp, Homo sapiens
  Payload ID: 5128
  Gene Symbol: DCTN1
  Gene Name: dynactin 1
  ENST ID: ENST00000454119
  CDS Start-End: 264-627
acggttcctgacaagtctagagcagcactagcgcagagtgagactcatcagctggcaagcaggattctgtgtctctgggttcaggaatcctcaggcagcagaggggacttgctcctcagcccccatcactgcccccacccctacccgtgtaggccaccgagtgaggcccatggactggggagggctgtgcctgacgactcctgtgtccctctatgagggcccagcgccctgaccctcctgcctagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcggggactgaagcctaagaagg

SEQ ID NO: 128338 - DNA, 561 bp, Homo sapiens
  Payload ID: 5128
  Gene Symbol: DCTN1
  Gene Name: dynactin 1
  ENST ID: ENST00000449655
  CDS Start-End: 521-561
agtgccaggaacttgctggttgattcagggggaggaatcagcaggaacttcgaacagcctaagtaggacttctgataccactgagaggattgaggttcttgagtgcagggctgagtgcctcttgccttcttgcagaagttcctatattgaagataagtgaagcatatagcatagcttttcttcttgacttttagaggtctgggcccttggaggtgggcctggaagtcactggatatttctggggaaaggggacattttgagatggagtagagctgcattcagagtgggagtgggtttgtagacgtttttttagggtaatgaggagctggagaagggaaggaagtccgttgagtgtgtaggccttatctatgaaatccgcaaggcagatactgagtaggacctaggaacaaaaagctctgtgtacgttgtcttctggggtcctgtgaatatctggaatccagctttccaagcttccagtctcccagcctccatttaccactcaacgcccagcggcagcaggatgagtgcggaggcaagcgcccggcctctgcgggtgggctc

SEQ ID NO: 128339 - DNA, 542 bp, Homo sapiens
  Payload ID: 5128
  Gene Symbol: DCTN1
  Gene Name: dynactin 1
  ENST ID: ENST00000421392
  CDS Start-End: 315-542
actctgccaaccgtctgctccgccggccccctacgtgttcgtgagtgaggagagcagcaaacccatgttgaccactggctactcagttcccaggtgatgctaatgctgctggcccatggaacacaatctgagtagcaaaagtatagatcactggattgaaagttagagaccatgttttccagaacagatgtgctgccttgagagagtcactttatctgtccaggcctataagttgaggtaaccgggactcaggaagttaaatatcttgctcagaggagaaccaaaggtatattcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccag

SEQ ID NO: 128340 - DNA, 593 bp, Homo sapiens
  Payload ID: 5128
  Gene Symbol: DCTN1
  Gene Name: dynactin 1
  ENST ID: ENST00000413111
  CDS Start-End: 366-593
gattctgtgtctctgggttcaggaatcctcaggcagcagaggggacttgctcctcagcccccatcactgcccccacccctacccgtgtaggccaccgagtgaggcccatggactggggagggctgtgcctgacgactcctgtgtccctctatgagggcccagcgccctgaccctcctgcctaggtttctaccttttctctctgtctttggccagctgggggagggggtagaggccgggtgagcaacatggcacagagcaagaggcacgtgtacagccggcaacatagcatggagaagaatctccagagcttggggatagagagttgaccaaacaagactcaggccagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccag

SEQ ID NO: 128341 - DNA, 565 bp, Homo sapiens
  Payload ID: 5128
  Gene Symbol: DCTN1
  Gene Name: dynactin 1
  ENST ID: ENST00000458655
  CDS Start-End: 6-565
acttgatgcttatgggcctgctgaggccttacatcctgggggagaggggaacagtgatgacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcggggactgaagcctaagaaggcaccgacagcccgaaagaccacaactcggcgacccaagcccacgcgcccagccagtactggggtggctggggccagtagctccctgggcccctctggctcagcgtcagcaggtgagctgagcag

SEQ ID NO: 128342 - DNA, 4229 bp, Homo sapiens
  Payload ID: 5128
  Gene Symbol: DCTN1
  Gene Name: dynactin 1
  ENST ID: ENST00000434055
  CDS Start-End: 93-2765
ggccggccccgcagggtcttgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcaggtgggcctggatggctgggtagaaggtgtggggagagttagtgaccagtgtggggcttttacttctgcccttggctcctgcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagt

SEQ ID NO: 128343 - DNA, 4485 bp, Homo sapiens
  Payload ID: 5128
  Gene Symbol: DCTN1
  Gene Name: dynactin 1
  ENST ID: ENST00000628224
  CDS Start-End: 370-4140
agaggctagcacggttcctgacaagtctagagcagcactagcgcagagtgagactcatcagctggcaagcaggattctgtgtctctgggttcaggaatcctcaggcagcagaggggacttgctcctcagcccccatcactgcccccacccctacccgtgtaggccaccgagtgaggcccatggactggggagggctgtgcctgacgactcctgtgtccctctatgagggcccagcgccctgaccctcctgcctaggtttctaccttttctctctgtctttggccagctgggggagggggtagaggccgggtgagcaacatggcacagagcaagaggcacgtgtacagccggacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcggggactgaagcctaagaaggcaccgacagcccgaaagaccacaactcggcgacccaagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgc

SEQ ID NO: 128344 - DNA, 4160 bp, Homo sapiens
  Payload ID: 5128
  Gene Symbol: DCTN1
  Gene Name: dynactin 1
  Uniprot ID: Q14203
  ENST ID: ENST00000633691
  CDS Start-End: 384-3818
agtggctccacccccatggagcagaggagggtgggtgcatgacgtcaggtggagctggtgctgcggccactgaggctgccatcagcctaagctggtgaactgggccaggcaccgctccggtgcctgccggagcctggcgatccagctgcacgtctgcgggggcctctgtgtcagagcggcggccgtttgcaggctgggaagctgccgcaccgggaggctgagactgcattgttgggatttgatgcactaatctcctgtctccgccgcctttccctctgttcggtctcttgccctccctcccttcgtctgtccttcctccgtgtgtttgtctatcctcctctgtccctcctctttcctctccttgctttctttggttttctgcaatgatgagacaggcaccgacagcccgaaagaccacaactcggcgacccaagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtgaagaacagcagcgaggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcag

SEQ ID NO: 128345 - DNA, 1677 bp, Homo sapiens
  Payload ID: 5129
  Gene Symbol: DCTN2
  Gene Name: dynactin 2 (p50)
  Uniprot ID: Q13561
  ENST ID: ENST00000434715
  CDS Start-End: 79-1299
aacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcgtttgcacaagagctggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctg

SEQ ID NO: 128346 - DNA, 1321 bp, Homo sapiens
  Payload ID: 5129
  Gene Symbol: DCTN2
  Gene Name: dynactin 2 (p50)
  Uniprot ID: Q13561
  ENST ID: ENST00000543672
  CDS Start-End: 110-1321
tccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggagctggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtga

SEQ ID NO: 128347 - DNA, 1527 bp, Homo sapiens
  Payload ID: 5129
  Gene Symbol: DCTN2
  Gene Name: dynactin 2 (p50)
  ENST ID: ENST00000550201
  CDS Start-End: 90-1037
cccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaa

SEQ ID NO: 128348 - DNA, 384 bp, Homo sapiens
  Payload ID: 5129
  Gene Symbol: DCTN2
  Gene Name: dynactin 2 (p50)
  ENST ID: ENST00000550086
  CDS Start-End: 1-384
gaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagaatcccctttctgcaggtctacagggagcctgtctcatggagactgtagagctgttgcaagcaaaggtgagcgccctagaccttgcagttttggatcaagtggaggctcggctacagagtgtcctg

SEQ ID NO: 128349 - DNA, 1439 bp, Homo sapiens
  Payload ID: 5129
  Gene Symbol: DCTN2
  Gene Name: dynactin 2 (p50)
  ENST ID: ENST00000549394
  CDS Start-End: 58-195
gaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcgtttgcacaaatcttcaagacactgctggagtaggtgctactggaggactagagtgtgctcccgggccacagccttggagaggctccagaggatgccagcgccaggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggttt

SEQ ID NO: 128350 - DNA, 2061 bp, Homo sapiens
  Payload ID: 5129
  Gene Symbol: DCTN2
  Gene Name: dynactin 2 (p50)
  Uniprot ID: Q13561
  ENST ID: ENST00000548249
  CDS Start-End: 269-1474
aatcctaggcggcgtcccctggccattacctcattccctggcctcgttctccccaatcccggcctctccaggggtgtggcagcagggctgttctcgcgacttttgctttacccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccat

SEQ ID NO: 128351 - DNA, 580 bp, Homo sapiens
  Payload ID: 5129
  Gene Symbol: DCTN2
  Gene Name: dynactin 2 (p50)
  ENST ID: ENST00000546670
  CDS Start-End: 123-580
gctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaaggtcgcagaacttgaaaagcgcctgacagagctggagacagctgtacgttgtgatcaggatgctcagaatcccctttctgcaggtctacagggagc

SEQ ID NO: 128352 - DNA, 817 bp, Homo sapiens
  Payload ID: 5129
  Gene Symbol: DCTN2
  Gene Name: dynactin 2 (p50)
  ENST ID: ENST00000546758
  CDS Start-End: 1-807
gttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgg

SEQ ID NO: 128353 - DNA, 567 bp, Homo sapiens
  Payload ID: 5129
  Gene Symbol: DCTN2
  Gene Name: dynactin 2 (p50)
  ENST ID: ENST00000550750
  CDS Start-End: 162-567
ttacccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgg

SEQ ID NO: 128354 - DNA, 892 bp, Homo sapiens
  Payload ID: 5129
  Gene Symbol: DCTN2
  Gene Name: dynactin 2 (p50)
  ENST ID: ENST00000550954
  CDS Start-End: 59-892
cgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggagctggtaagaagcctgacctttcatctgctttttaacggggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttg

SEQ ID NO: 128355 - DNA, 808 bp, Homo sapiens
  Payload ID: 5130
  Gene Symbol: DCTN3
  Gene Name: dynactin 3 (p22)
  Uniprot ID: O75935
  ENST ID: ENST00000259632
  CDS Start-End: 17-577
tgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatga

SEQ ID NO: 128356 - DNA, 899 bp, Homo sapiens
  Payload ID: 5130
  Gene Symbol: DCTN3
  Gene Name: dynactin 3 (p22)
  Uniprot ID: O75935
  ENST ID: ENST00000341694
  CDS Start-End: 11-541
ggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcaggctccatggggagtgggagtccgtgatgaggcaggaagtttagtggaagatgtgggctttgcccagttcctttctgtgctacactttggccctacaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatga

SEQ ID NO: 128357 - DNA, 482 bp, Homo sapiens
  Payload ID: 5130
  Gene Symbol: DCTN3
  Gene Name: dynactin 3 (p22)
  ENST ID: ENST00000378911
  CDS Start-End: 1-482
atggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcaggtaatgctggactacatgtgtacatgcatctgaggatgtgggtcgtcggggaggttaagcacagagatggcctctccatccagtcttctggtggatacaagccctggatgctgctctctggaattgtggcctggttctgggttgaggatcctatggatcctctagtagacattgagtacagtatacctctgcaccagctgcaggccatggtgcc

SEQ ID NO: 128358 - DNA, 951 bp, Homo sapiens
  Payload ID: 5130
  Gene Symbol: DCTN3
  Gene Name: dynactin 3 (p22)
  ENST ID: ENST00000378913
  CDS Start-End: 18-446
gtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcaggtatgggaggggagatgactagaagcgaagatggaggtggcgcagcacctcatcccaactcatgccacctggggaagcagcttcaggcctttctgttgtaacctcagcagaaactttggggtttatcctttatcttgcatatgccccagggaggtaaagggacttgcctaggttcatgtacaaactttctgcttccagagcaggactttattgggacaccataaggttgaggctgggaggtacccaagaattcctggggatggtatgtcattgactgtgggtagaggggctcttttttcactattcccaggccctagtgtaaagttcaaagagagttcagaaataaggacagaagaagagacatacactagggggaatgtttacttaatgtatggccactcccttttccatccgtctttggactgctgttagggcacccatcctggagcctgaaagtgctcccatagccatttgctcctttggctttggggttaagcgtcatcttttttaggctccatgggga

SEQ ID NO: 128359 - DNA, 773 bp, Homo sapiens
  Payload ID: 5130
  Gene Symbol: DCTN3
  Gene Name: dynactin 3 (p22)
  Uniprot ID: O75935
  ENST ID: ENST00000378916
  CDS Start-End: 60-536
atttggactgacgtcccgccctctggctgtttcctggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgactggag

SEQ ID NO: 128360 - DNA, 687 bp, Homo sapiens
  Payload ID: 5130
  Gene Symbol: DCTN3
  Gene Name: dynactin 3 (p22)
  ENST ID: ENST00000421919
  CDS Start-End: 1-456
cagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatga

SEQ ID NO: 128361 - DNA, 713 bp, Homo sapiens
  Payload ID: 5130
  Gene Symbol: DCTN3
  Gene Name: dynactin 3 (p22)
  ENST ID: ENST00000477738
  CDS Start-End: 5-535
agcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcagattcctattctcaccttgacctacaaccagacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacaccc

SEQ ID NO: 128362 - DNA, 4054 bp, Homo sapiens
  Payload ID: 5131
  Gene Symbol: DCTN4
  Gene Name: dynactin 4 (p62)
  Uniprot ID: Q9UJW0
  ENST ID: ENST00000424236
  CDS Start-End: 442-1653
actgcctttccaggatttattgcgaggatggagggaggcgcaggcgttctcattcatagttctcccatcctgaaagttctgttcctcttttgtccagaaactgggccctcgtcagactgccttgccctgttcctgactcaggccaaggcctgcagccgggaagaggttggggcggcgtgagttatgtgaaaagcgctcagaatacagtatgtcatgtaagaagctgaaagtgtatttatggagctagaggacaatgctgtccttccctggcacaagtgggcgtccgaagttggatttttcaaaaagaagaccccggccagtaaaaagtcaccaaataacaaaaccccaaaacttctgcagcgcttggcacatcttgtttattcagtaagctttagggattaaaaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttatttcactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttg

SEQ ID NO: 128363 - DNA, 1737 bp, Homo sapiens
  Payload ID: 5131
  Gene Symbol: DCTN4
  Gene Name: dynactin 4 (p62)
  Uniprot ID: Q9UJW0
  ENST ID: ENST00000446090
  CDS Start-End: 43-1446
acgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcgcaacatactattcatgtagtggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttcctt

SEQ ID NO: 128364 - DNA, 4208 bp, Homo sapiens
  Payload ID: 5131
  Gene Symbol: DCTN4
  Gene Name: dynactin 4 (p62)
  Uniprot ID: Q9UJW0
  ENST ID: ENST00000447998
  CDS Start-End: 117-1499
gtgggaaacctaacgtcaaagtctacgtaggaagtcgtagggaaggcagcgaggaagacgctggctctcgggtcacgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttatttcactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttgagcgtgtcttttgtttgctctcatgtagatactaagtagcatggctcagagccaaaagacaagcgtgaagttaagagagttggctaagagagttggtggggcatgctcccttccattccttaaatgaagtaatctaaaatctcttagcaggttagttcaccataatatataagtagatgttgctttgagcttcttatatacatattcacagaaccattatataaatgttgttagacctctaccagtttttatcctgggtcattgcttctaaagatatcctttacaatatacacagtggtctgactcca

SEQ ID NO: 128365 - DNA, 661 bp, Homo sapiens
  Payload ID: 5131
  Gene Symbol: DCTN4
  Gene Name: dynactin 4 (p62)
  ENST ID: ENST00000521728
  CDS Start-End: 387-661
gcgccgtttcctaagcctgttggaaaagcgcagtattcgggtgggagtggcccgattttccaggtgccgtctgtcacccctttccttgaccaggaaagggaactccctgatcccttgcgcttcccaagtgaggcaatgccttgccctgcttcggctggcgcacggtgcgctgcacccactgtcctgcacccactgtctggcactccctagtgagatgaacccagtacctcagatggaaatgcagaaatcacccgtcttctgcgtcggtcacgctgggagctgtagaccggagctgttcctattcggccatcttggctcctcctaagtcttgctcttttcaagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaag

SEQ ID NO: 128366 - DNA, 585 bp, Homo sapiens
  Payload ID: 5131
  Gene Symbol: DCTN4
  Gene Name: dynactin 4 (p62)
  ENST ID: ENST00000521448
  CDS Start-End: 28-288
agcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagactaggggaatgtattttgcggaggagaaccacagagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatat

SEQ ID NO: 128367 - DNA, 578 bp, Homo sapiens
  Payload ID: 5131
  Gene Symbol: DCTN4
  Gene Name: dynactin 4 (p62)
  ENST ID: ENST00000521533
  CDS Start-End: 236-578
ttattgcgaggatggagggaggcgcaggcgttctcattcatagttctcccatcctgaaagttctgttcctcttttgtccagaaactgggccctcgtcagactgccttgccctgttcctgactcaggccaaggcctgcagccgggaagaggttggggcggcgtgagttatgtgaaaagcgctcagaatacagtatgtcatgtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaa

SEQ ID NO: 128368 - DNA, 579 bp, Homo sapiens
  Payload ID: 5131
  Gene Symbol: DCTN4
  Gene Name: dynactin 4 (p62)
  ENST ID: ENST00000518015
  CDS Start-End: 178-579
acttggaaaggaggagcagcctcgggtgggactgagcggatcttctggttctagagcggcctctgattggacaaacttgacttagggaccgtgtctgtctgcgatggggcttggtaaagaaacagatacagagtgttcgctgtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgacca

SEQ ID NO: 128369 - DNA, 576 bp, Homo sapiens
  Payload ID: 5131
  Gene Symbol: DCTN4
  Gene Name: dynactin 4 (p62)
  ENST ID: ENST00000517421
  CDS Start-End: 103-363
gtcaaagtctacgtaggaagtcgtagggaaggcagcgaggaagacgctggctctcgggtcacgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagactaggggaatgtattttgcggaggagaaccacagagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggataacctg

SEQ ID NO: 128370 - DNA, 1774 bp, Homo sapiens
  Payload ID: 5131
  Gene Symbol: DCTN4
  Gene Name: dynactin 4 (p62)
  ENST ID: ENST00000627368
  CDS Start-End: 43-303
acgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagactaggggaatgtattttgcggaggagaaccacagagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcgcaacatactattcatgtagtggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttcctt

SEQ ID NO: 128371 - DNA, 11011 bp, Homo sapiens
  Payload ID: 5132
  Gene Symbol: DCTN5
  Gene Name: dynactin 5 (p25)
  Uniprot ID: Q9BTE1
  ENST ID: ENST00000300087
  CDS Start-End: 152-700
gaggccgcctaaaggagagccgcgctgtcgatgagtcccagtgggccacctggagcggaagtggaggagcggccggaagtagccggaatctctgaaagactgaccgactgactctgacaggatccggggctgagggaaggaggcggcggccatggagttgggcgagctgctctacaacaagtctgagtacatcgagacggcatctgggaacaaagtcagtcgccagtcagtgttgtgtggaagccagaacatcgttctcaatggcaagaccattgtgatgaatgactgtattatccgaggggatctggcaaatgtaagagttggacgtcattgtgttgtgaaaagtcgtagtgtcataaggccaccattcaagaagttcagcaaaggtgttgcattctttcctttacatattggagaccatgtctttattgaggaagattgtgtggtcaacgcagcacagattggttcctatgttcatgttgggaagaactgtgtgattgggcgccgatgtgtgttgaaagactgctgcaaaattcttgacaacacagtattacctccagaaactgtggttccaccattcactgtcttctcaggctgcccaggactcttctcaggggagctcccggagtgcactcaggagctgatgattgacgtcaccaagagctactaccagaagtttttgcccctgacgcaagtctagcatctctgcctcatgtcttgaatctgcttgagctctaagatgaacctggggacaaagtgagccagtcagcacctacaaagagcttttgtgtctttgacatctaccaccctcctccttttaaaaaatttctttagaatttctcaatcttcaaggctctaagtgcttaagaattcactaacagacagaccatctggaggagctgtcttcaaatgctgtgcttacaccttatctatgaacagtcactttgtaccattatctgtggaacacagaatcatctgttcccaacactccagccccttggtcctgtggatggctggatcccgcctgaaacggacctgcagagcagcagcacccttccggtgtggaggctatgtagctggtgcgctgctcacggccattcactgcccatgctgagcgcctctcacacaggtaatgcccagcttttctgctgctaacacatttggccagttgttgcagttgctcatcatcttgggaaaggtgtttgtgacttttcagagcccagattcctgttgtctattaaaacttgaagggaggggtgaatagtgtttctctcttcttcccaaaatgaccttagctgtcctaggatagttagtaaaagactttttagcattttgacctagggcctttggctttcactaaaagtggggacctcagtatcccagattgtaattttgccaagtgttagatttgagtctctcatgtggatgcattagtcaggtggttactccttgcttcaaggtacttaccttatttcattgaagacaccgcatttgtgaactcttgcttcctggcctagaaccattcagcctaccctgtatttgccataaactccacaattcacaccaaaatgtctgtacttagagctaattcgcatatatacaggaagggctcttagaatcagtttgtgggcacagagcctcaggagtaaatgaagttactagggctgttcttaccatctccttctggccaaatagcacaacatttcctcgttctgctctgacctcttagcttagaaggaagattcagaagtgaggggctaagaaggttgtccttgcctaatgctctgatctgtaagtgaatagggcagaacagttcagccttgaggttagaatttagcaggagctatcctgacttaatatccagttgtggggtttgcaaaacaaaacagctgtatgtaatcattgccactagttccatctagaactcctttctagtttgttatttttaaaatgtttatacataaaaccaccaaaatacatagcttcgacaagatggaagtttatttctctctcccataacagtgcagtgatagtcagctggtccaggccaggcaaggggctggtccatgatgtcatcaggcacccaggttcctactgtcttgccatgtggccacagttagcaacaaaggaggctgtaaatttagtttctacttgggcagccaaaactctgaggaaggagattctgctagtaaaaaggagtgggggaagaatggccattgggagacaacaagcagactcaaccaggcctctttgttggcttcctttcctcctgctgcacatgagccttcgccgtgcatttggagccatgacagctgatagctccagacctgcatcctcctagcttgggggctctgaatgaaaggtttcttcccttccagttcgaatttggaaactcccaaagttctcaatggtttgttgtgagttccatgtcctcttggatcagtcactgtggccatgcatgtttggccacatgattaatccagtctgggtcatgaccttttcttcatccaaaacaaggtgatgggaagacaaaaacaatagctactacaaacaataggagtttataattatgtgctgatgtattcgaagatgtgttgacagtcgtgagtgtgtatcctaggaaaggcgagctggactctgtctccatggtggctctcaccccagggacctaggaacagcctgtcaccacacaattacttttataaccctggagatgaaaatctccttgtcctcaaaatacttccagaagaacaaccagatgggaaggaccttggttgggactctttccagttcacttggggcagagggaatttaatggctcacgtagctgaaaaggatgggctagattgggcttcaggctgcatcccaggactccaaacagggatctgtctctttggctctcagctctgctttcatttgagttggctttattcttgggcttcacagtgtggccccacagcaccagttattgataaaaagagctcccctttgctgacagaactgctggatttggttctcattggtccagacgaggaaggtatccagcctcaagtcatcattgtggccaggaagatggaatacaccaaatggacaggcctggcatgtacccacagagactgagagttggtgctggtggttgtggtggcagatgatattacctgaagaagggacgaatgggtgctgggcaggacaaagcatcagctgtccagttcaggcctctcctctttccctggtgtcttcattttcctccgtctccctgctgtcccttaccctctgcccaatctctcattactcctggtcttgggagttgccttctgaggatactccactgggggtacctgagcctggattagagggcagggggaggatattgcctagccaaagtgggtgttcaataaagaaccatttggagatggtcttctgtctggaactgcttcctttttgttttattatttttccccagatgagctgactgggccatggaactgcatccttatggttcccatagcaccttaccgaggcgcccttatcaatagagttttagttatgtacctgtgttcttgtctgaacccctactaactgtgagctcctgaggagtcaggcctgagtctgtgggtcatctagcacatccttaatagaatgattgcctggatgtgaccaccctcacccccaaccctcacacaccctgccagcatgcctcagaccttaccccagctcaagataagtctcagattgcaggatacctgctgcagggaacaaaggtgaatgattgtcttgtgagcctcctgttgactgattctgttttacatggctgcacagagcccttgtggttatttggggttggggtggtggcttctgtattagtcacttctgcatgaaccatttcactcaggatctgaggccacagttcctttcttagtcactgatacatctggcagacttgaaattaatcagacaaacattgttcatagttaacatatccttggaagtttctcagctataaggaagaggtcttggtggctagggaggcctttctctgtatcctgttctatccagtgagagcctagagggtgctgcccagccatattctggctagcctcagcggttctcctgaaaaaaaattggcatctgacaacctggatggtgactataggtagtcaaatccagctggctggtctcctgggggttagcttccatggagctgcaagtcccctgaaatgatactggcagtgttgggacagcgtgtccgaaggcctggttttttcagaactggtctcagcaaaatgtctcgccaacttctacagttcccataagtacatgataactgaaacacttctagagccccccagcaatgggcttgtgcttttagtagaatatgtgcttgcttccatttaggggtaagaaggtgggcccctcaccatatgctgcacagagaagagagacaccatcactcatttattcatttaacaagtgctttccaagccactactaggtgccaagcacttcctaggtcctggggatacagtggagactaagatggagccagttctttctcatagggatctcacagcttagtgagtgagaaagccaaagagtcaaaatacagagagggtctgaggggcccattttgagagccatcatagtggtgaggagtgtgagtgctagagtcaggctgatcaaatcccagcctgccattggctagccttgtgactttgagcaagttatcttacttcgtggaacctcaggtttctcatccataaaatggggaagttggatagggtattatgatgattgaaatgcatttatacatgtaaagcataagtactggctcagggtgagcactcaataaacggcagtttattaggcacttttattaggaagtgatacaccttgagcaaaaccccttagagtataaggcatagcattcttacatatttttaaaatttaaaataaaatttaaaacatcttgccctttataatcagtccgccacaaacaagagatggagaaatcacccttccttgttttgtatctatggggtgcaaacatttaatcctcccaactgtcaaaaaagtgagagtttcacagcctgttttacagcagaggaaactgatattcagagaggttaagtaaatttgcccaatgccacacatctaataaatggctgagctggaatcaaggccagctcttacttggctgcaaaatccatgttttatgcagctcctccactatcttggcctccaaggcagctggctttgaacactacccttgcagcccagtcagccaatcccttgctctcctgaagcttttgctggtgggccagccccacctgctttccttgtgcactctgacttggaccctgaagtgagaagagttggcacaggacatcttacttccctgaaaacagtacctggacttttctgtatcttcacatccattgggcattgggcaaatgggtcatgcagatgaaaaccatccaagataagagacatgggagtgaaattcacacccactctggctttcataccatgggtctgaacattagcccatggtgtttcttggccatactgacctgtgccatttcagctgcattcatctcagttggtgttgtctgctggctgctctttctgatttcccacaggagcagtaagaacctgaggaagagtagggtcagaggagtctgggagaatgaggaaatatgagagccccaggaactgaaaaggcctgtgagagactctgagcttcctgggaacaggtataggttctttttatttcaataataacagaaacaactgtcaaaaccatgtgcctgtactatttggagtgctgtccttgcagaatctcattataagaaccttaggaaataggcacatcatctcctggatagaatcctaggaaatgggcactataatgggcactttatcccattttataaacatggaaattgaggcacagagagattaagtactttcccaaggtcatacagctagtgatggaggagctagcatttgaacccggagtttttagtctattgagtttaaccgacagatcatactgtgttttggtagggagggagggaggaagcaagcaagtgaacaaatgagtctgggatttaggacttgccagacaaacaaggcccaagaggcaagtgtgcaggtgggtgtagttgggagtcagcagagttgggttggaattcaagctttgccacctgctggctataaaccttggttgggtaagtaacccaaggtaaatgagatcatctctgtaaaactcttagccttgtgcctggcacatagtaaatgcttaataagggttcactgttagtattactgttactgataacatacaaatagattgtattaatggaccataattgcaactgtataaaacaaattccatgtttggccaggcgcagtggctcaagcctgtaatcccatcacttcgggaggccgaggtgggcagatcacgaggtcaggagatcaagaccatcctggctaacacagtgaaaccccatctctactaaaaatacaaaaaaattagccaggcatggtggcgggtgcctgtattcccagctacttgggaggctgaggcaggagaatggcgcgaacccagggggcggagcttgcagtgagctgtaattgtgccactgcactccagcctgggcgacagagcgagactccgtctcaaaaaaaaaaaaaaaaaccacaacaacaacaacaaaaattccatgttgacaaggatgggaatatgagaacatggaaacagctatgaaaagacataagagaattaggaggattttctttaatatatcattttttaaaaaaaaacttgcttgtatttgtttattttttaaatagagacagggttttaccatgttgcccagactagtcttgaactcctgggctcaagcgatcttggcctccctaagtgctgggattacagtcatgagccactgtgccccgccattttttaataaacctttctaatggaacaagtaaaacacatgcagtggatgctcagcaggccttgagtgtgtgaatgaaaaatatttgaacttgtttttactggttgatttcattgcttaaaaaacataccttagctggacgcagtggcgtgcgcctgtagtcccagctactcatctcttaaaaaaaaagttttatgcttgttaatttcataaatgctagagggatcaccctaatcaaataaagctactcaaaaataaaatatgaaaggtgttagtgggatacagctttctagttttttgccactagtggataggttggaatttaaattcttcggatattggaaccagaacaggctgtaactgattatttttgctgtgattcgtgcttactggagcctcgggaaagagggagacaacatgtaaagagaagcaatctgtttggaaaatgaaaatacagttaaattgctaatgaacccttgtcaaaatcaaatgtctccccttagaggctgatgattgtctagtctaatatgcattttttttgagtgggtcaattggactctaagaccaacaagataaaaaggcagccttgcatgtcacttggaccacagctgtctggccatgcagcatgccttcactgctgctgaagaaaagcagctgcttgttgagaatctcaaattctcagatcctaattgcctggccctgactctaagctgaaacctgctactgtctgccttgagctgttttagcctcaacacgagctatgctgaactgaaagcaggcacaggctcaatgaccaggactcagacgttggggccgttggagattaaggaccccctccgtggagcgctaaactatgaaaacgtcctggaacctggctgaaaagggcttattctctaatgggaccatctaagatcaagctgctgataggctctttgtctctaatacagaggctaattgcattcctaacttctaatatttgccaaacgctccaagctggggaagggcacatcgcaaggactatgacctctcctcctgcttttgacagaccagactcaaaccttctctggggcttctctcactgctgttgacttgttgcattcagcttttgggattagttgcagcttgcaacagtggactgacagcctgactctacttccctcacttttctcccagcacacacagcttagtaaggtaggtggattattaaaacgtagctgtccccagaaaggtattaggcttttctagtctgctcattgaataatcaggacaaaaggggtagaagattatgtaaacacattttgaaatttttaaaaattcagggtttcatcctttattagtttgctaaggataccataacaaagtaccacaaactgagtgacttacacaatagaaacttattttcctgcagttctggaggctgaaagtccaggacaaggtgtcgacagctttagattcttctgaggcctctctgcttggcttgcagatggctgccttcttactgtgtccttgtatggtccctctgtctgggtgtctgtgtcctaatcttctcttttaataaggataccactcaggttggattagggcccatcctaacaatcccattttaacttagttacctcttcagggcctatcttcaaatatactcacattttgaggtacaggtagatggttagggcttcagcatgaatttttgtggggacataattcaaccctccacacataattaccaatttctgaatgtctttctggttaagttgcataaaaacgtttatctacttgaactctaggatgatagttaaaaaaaaaaatgttggccaggcgcagtgatggatgcatatgatcccagcactttgggaggccgaggtgggcagattgcttgagttcaggagttcaagaccagcctggcaacatggtgaaatcctgtgtctacaaaaaatgcaaaaattagctggacatgatggcatgtgcctttggttccagctacttaggaggctgaggtaggaggatggcttgagcccaggaggcggaggttgcagtgagccaaaatcgtgccaccgcactctagcctgggcaacagagccagaccatatctcaaaaaaaaaaaaaaaaaagtttatctacaaaaatgcttttgtgcctcttacatacaacccttccagaggaaaggcctagctgagagtaagagatggttgaaaaaatgcaatgttatgattgctgaacagggcacgactgtttttgtaatattggagaaaataattaaagcctggcacctggggaggcttgatccctggaagcctcctcttgctgaaggaaaattcccagtgctgcctttccatgtgctgtgagtgctttgagttcagactgacaacagagtgggtctagcttctatgctttccatgaagatctcccacaaatgtcatccatgctcatgagatggatcaacttgtatcctgaacaagcaaaactgtttgggactcactgccttcaggcagtcccttggaagccaaggactctgggaacttttcagatgggactggaaacacttgggcaggagttcccctggtaggaggtctgttcacctgtacagcctaatggatgtcctgcttgaggtgccctaatattgcaaattctttgtttacaggggtaccacctgtgcccctgggactgtgcttctgtacatgaccacaactctcatgatgtcccctcagccctggaaagcatttgggttagcttccgcttactggtcagagttatactgtgcctgaattgatgcctcaggtcaggttgaaaaaaaaaaaaaaggttcagacagcaattaagggctgggcacggtggctcatgcctgtaatcccggcactttgggaggctgaggtgggcagatcacctgaggtcaggagtttgagaccagcctgaccgacatggtgaaaagtaaaaatacaaaaataaaaaaattagctgggtgtggtggtgtgcacctgtagtccctacaaaaataaaaaaattagctgggtgtggtggtgtgcacctgtagtcccagctactcgggaggctgaggcaggagaatcgcttgaacccaggaggtggaggctgcagtgagccaagatcacgccactgcactccagcctgggtgacagagcaagactccatctcaacaacaacaacaaaaaggaattaaggaggaagccacctggcttcctaagatagactttatggttaatgggatttattttagctggttaagtccaggacccctaccaggaagaactgaggtccatatttgaggttggtctcacccttttgcatgtggtcctactaataataattttgctgtaaagaagcctcaataaggagatggactgtgtgaaaagagatgagaaagcaggcctgtttgcaaggctggcccttggctggcatctgaaagcttggatttcaggagggttctcattactccctaaatgataagagtggctcactgtgcctaaactgttcgtacaaacaatgtgggttatgcccaacatctgctttccttctgggagtcagattttcatatgtgttaggcagaggatgaggtgagcagctcccaatgagaaccctgaacactgagtctgtaatgagcttcccttgtatacaacattgcacatgggttgtcacaactgattgctggaggaattgtgtcctatgtgactctgctgggagaggactgtgggaggcttacacctggtttccctggactttgtccatgcgcttttttcctttgctgattttgcttcctagcctttcgctgtagtaaaacatagccatgagtatgactacaggctgagtctgtgaatctcctagtacatcatcagactaggaggtggtggtgttggcaccccccagcacagggcacaagggagacttgcagggtgtttgtcatgttccctttctcaatctgggtgtggtttacagatttgttcagtttgtgaaaattcactgagctctatgaacaattataatatgtacatttttttctgtaagtgtattaaatttcaataaaaagaattcacact

SEQ ID NO: 128372 - DNA, 878 bp, Homo sapiens
  Payload ID: 5132
  Gene Symbol: DCTN5
  Gene Name: dynactin 5 (p25)
  Uniprot ID: Q9BTE1
  ENST ID: ENST00000563998
  CDS Start-End: 73-531
tagccggaatctctgaaagactgaccgactgactctgacaggatccggggctgagggaaggaggcggcggccatggagttgggcgagctgctctacaacaagtctgagtacatcgagacggcatctgggaacaaagtcagtcgccagtcagtgttgtgtggaagccagaacatcgttctcaatggcaagaccattgtgatgaatgactgtattatccgaggggatctggcaaatgtaagagttggacgtcattgtgttgtgaaaagtcgtagtgtcataaggccaccattcaagaagttcagcaaaggtgttgcattctttcctttacatattggagaccatgtctttattgaggaagattgtgtggtcaacgcagcacagattggttcctatgttcatgttgggaagaactgtgtgattgggcgccgatgtgtgttgaaagactgctgcaaaattcttgacaacacagtattacctccagaaactgtggttccaccattcactgtcttctcaggctgcccagctccttagagctgggtctttctttccccaggactcttctcaggggagctcccggagtgcactcaggagctgatgattgacgtcaccaagagctactaccagaagtttttgcccctgacgcaagtctagcatctctgcctcatgtcttgaatctgcttgagctctaagatgaacctggggacaaagtgagccagtcagcacctacaaagagcttttgtgtctttgacatctaccaccctcctccttttaaaaaatttctttagaatttctcaatcttcaaggctctaagtgcttaagaattcactaacagacagaccatctggaggagctgtcttcaaatgctgtgcttacacctt

SEQ ID NO: 128373 - DNA, 523 bp, Homo sapiens
  Payload ID: 5132
  Gene Symbol: DCTN5
  Gene Name: dynactin 5 (p25)
  Uniprot ID: Q9BTE1
  ENST ID: ENST00000568272
  CDS Start-End: 15-269
aggaggcggcggccatggagttgggcgagctgctctacaacaagtctgagtacatcgagacggcatctgggaacaaagtcagtcgccagtcagtgttgtgtggaagccagaacatcgttctcaatggcaagaactttgtcatttctgttttcctgagcccatatatcagatgtcacagtgcctgcagggatagaaagagatcagatgagtcagtaagactgagtgtgaacaatagagagtggtggggcctggtgaattggagaatgtgaccaatctaagcccaagctggttgttactgtgtgggaatacaggcccacgtggcaacaatcagctttccagagcgtctgattctttttcaaaagcaactggaaatctcactttttaaaatgcaagatgttccactactcaaatagtaatgtttaattttaaatgatttgttaaaatgccacgtgtccttcctgtaggagatagctaaaaaaaattaaaagaaataaataataaaaatgctgcatgagccaaacaa

SEQ ID NO: 128374 - DNA, 772 bp, Homo sapiens
  Payload ID: 5132
  Gene Symbol: DCTN5
  Gene Name: dynactin 5 (p25)
  ENST ID: ENST00000568589
  CDS Start-End: 33-500
ggatccggggctgagggaaggaggcggcggccatggagttgggcgagctgctctacaacaagtctgagtacatcgagacggcatctgggaacaaagtcagtcgccagtcagtgttgtgtggaagccagaacatcgttctcaatggcaagaccattgtgatgaatgactgtattatccgaggggatctggcaaatgtaagagttggacgtcattgtgttgtgaaaagtcgtagtgtcataaggccaccattcaagaagttcagcaaaggtgttgcattctttcctttacatattggagaccatgtctttattgaggaagattgtgtggtcaacgcagcacagattggttcctatgttcatgttgggaagaactgtgtgattgggcgccgatgtgtgttgaaagactgctgcaaaattcttgacaacacagtattacctccagaaactgtggttccaccattcactgtcttctcaggctgcccaggtaaccttggctgttgattaattttattttaacttcctaaaactcagttgtattttccatcgcaaaagtaatgcttacgattcctatctctggcaatatgttgatagagctaacttagaaattcacctgtacaaagtacctagaaatgctacctaacatataacaagcatctgtttaaatgcataattgggttcaccagaaaataaggaaattatgaagggccaaacacaaagaggaaactaagcccaagctgtgagattgcacgggttaatgctgtcttcataataga

SEQ ID NO: 128375 - DNA, 547 bp, Homo sapiens
  Payload ID: 5132
  Gene Symbol: DCTN5
  Gene Name: dynactin 5 (p25)
  ENST ID: ENST00000563188
  CDS Start-End: 31-258
atccggggctgagggaaggaggcggcggccatggagttgggcgagctgctctacaacaagtctgagtacatcgagacggcatctgggaacaaagtcagtcgccagtcagtgttgtgtggaagccagaacatcgttctcaatggcaaggctggagtgcaatggcgcgatctcggctcactgcaacctccgcctcccaggttcaagcgattctcctgcctcagcctcccgagtagctgggattactgcagaccattgtgatgaatgactgtattatccgaggggatctggcaaatgtaagagttggacgtcattgtgttgtgaaaagtcgtagtgtcataaggccaccattcaagaagttcagcaaaggtgttgcattctttcctttacatattggagaccatgtctttattgaggaagattgtgtggtcaacgcagcacagattggttcctatgttcatgttgggaagaactgtgtgattgggcgccgatgtgtgttgaaagactgctgcaaaattcttgacaacacagtattacctccagaaactgt

SEQ ID NO: 128376 - DNA, 571 bp, Homo sapiens
  Payload ID: 5132
  Gene Symbol: DCTN5
  Gene Name: dynactin 5 (p25)
  ENST ID: ENST00000566053
  CDS Start-End: 68-229
ggaatctctgaaagactgaccgactgactctgacaggatccggggctgagggaaggaggcggcggccatggagttgggcgagctgctctacaacaagtctgagtacatcgagacggcatctgggaacaaagtcagtcgccagtcagtgttgtgtggaagccagaacatcgttctcaatggcaagtgttgcattctttcctttacatattggagaccatgtctttattgaggaagattgtgtggtcaacgcagcacagattggttcctatgttcatgttgggaagaactgtgtgattgggcgccgatgtgtgttgaaagactgctgcaaaattcttgacaacacagtattacctccagaaactgtggttccaccattcactgtcttctcaggctgcccaggactcttctcaggggagctcccggagtgcactcaggagctgatgattgacgtcaccaagagctactaccagaagtttttgcccctgacgcaagtctagcatctctgcctcatgtcttgaatctgcttgagctctaagatgaacctggggacaaagtgagccagtcagcacct

SEQ ID NO: 128377 - DNA, 744 bp, Homo sapiens
  Payload ID: 5132
  Gene Symbol: DCTN5
  Gene Name: dynactin 5 (p25)
  ENST ID: ENST00000566298
  CDS Start-End: 447-744
atcctctagcctcagccttctgaggagctgggactacagacacgcgccaccatgcccggctaattaaaaaattttttttttgttgagaaggggtctcactatgttgcctaggctggtcttgagctcctgtcctcaagggatccgtctgcctcagcctctcaaagtgctgagattacaggcatgagccaccatactcagccatagtttcctaatccatcattgcttttttgatatcctggactcactccattgtggacagcaccccactttatgtttttttctctcaaatgggagctttcttgatggaaacctgtagtccagaaacctattaagtttgctttccccggttttccgttgttttcttttaggcatctgggaacaaagtcagtcgccagtcagtgttgtgtggaagccagaacatcgttctcaatggcaagaccattgtgatgaatgactgtattatccgaggggatctggcaaatgtaagagttggacgtcattgtgttgtgaaaagtcgtagtgtcataaggccaccattcaagaagttcagcaaaggtgttgcattctttcctttacatattggagaccatgtctttattgaggaagattgtgtggtcaacgcagcacagattggttcctatgttcatgttgggaagaactgtgtgattgggcgccgatgtgtgttgaaagactgctgcaaaattcttgacaacacagtattacctccagaaactgtggttccac

SEQ ID NO: 128378 - DNA, 1127 bp, Homo sapiens
  Payload ID: 5133
  Gene Symbol: DCTN6
  Gene Name: dynactin 6
  Uniprot ID: O00399
  ENST ID: ENST00000221114
  CDS Start-End: 88-660
caaccctgccaggctctccaatcgcatgtggaattatcgctctacccaggcggtggtgtcgatctacgttccaattggggccgtaccatggcggagaagactcaaaagagtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttggctgttattcccaagccatgaagatgggagataataatgtcattgaatcaaaagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacaggacctttagtaagcatactttaatcagtttttctccttgaattaatcttttctcttaatttttattatgtactagttgtattaaagctaatgtgtttacttttt

SEQ ID NO: 128379 - DNA, 878 bp, Homo sapiens
  Payload ID: 5133
  Gene Symbol: DCTN6
  Gene Name: dynactin 6
  ENST ID: ENST00000523666
  CDS Start-End: 15-236
attggggccgtaccatggcggagaagactcaaaagagtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaacaggcccttatcataaatgcattcccaagccatgaagatgggagataataatgtcattgaatcaaaagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacaggacctttagtaagcata

SEQ ID NO: 128380 - DNA, 540 bp, Homo sapiens
  Payload ID: 5133
  Gene Symbol: DCTN6
  Gene Name: dynactin 6
  ENST ID: ENST00000519830
  CDS Start-End: 10-123
ggccgtaccatggcggagaagactcaaaagagtgtgaagattgctcctggagcagttgtatgtgtagaaagtgaaatcagaggagatgtaactatcgctgggcatggtggtgcatgcctgtaatcccagctactcgggaggctgaggcaggacaattgcttgaacctgggaggcagaggttgcggtgagccgagatcgcgccgttgcactccagcctgggcaacaagagcgaaactccttctcagaaaaaaaaaaaaagaaaaaagaaaaaagaatttgccaggacctcggacagtgatccaccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttggctgttattcccaagccatgaagatgggagataataatgtcattgaatcaaaagcatatgtaggcaga

SEQ ID NO: 128381 - DNA, 820 bp, Homo sapiens
  Payload ID: 5133
  Gene Symbol: DCTN6
  Gene Name: dynactin 6
  ENST ID: ENST00000522141
  CDS Start-End: 66-206
cgcatgtggaattatcgctctacccaggcggtggtgtcgatctacgttccaattggggccgtaccatggcggagaagactcaaaagagtgtgaagattgctcctggagcagttgtatgtgtagaaagtgaaatcagaggagatgtaactatcgttacccagataatatcactcctgacactgaagatccagaaccaaaacctatgatcattggcaccaataatgtgtttgaagttggctgttattcccaagccatgaagatgggagataataatgtcattgaatcaaaagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacc

SEQ ID NO: 128382 - DNA, 880 bp, Homo sapiens
  Payload ID: 5133
  Gene Symbol: DCTN6
  Gene Name: dynactin 6
  ENST ID: ENST00000520829
  CDS Start-End: 16-528
aattggggccgtaccatggcggagaagactcaaaagagtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttggctgttattcccaagccatgaagatgggagataataatgtcattgaatcaaaagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcaggtactagaacctctctttaaaaagagttctatctgctgattttcccaaaatacaatgtaattgtcttcatgaggcagcaggtacactatttaagaacataattaaaataaaacaaaagatgccagtctcagtgactcgtgcctggaattctagcactttgggaggccgaggcaggaggatgacttgagggcaggaatttaagagcagcctgggcaacatagtgagactctgtctctacaaacactagaaaaactaagccaggtgtggtggggcatgactatagtccagctactgaggaggctgaggtgggaagataattcttgagtgtgaggttaccatgagccatgatcatgccactgcactccagcctgagcaacagagaccccaactc

SEQ ID NO: 128383 - DNA, 2027 bp, Homo sapiens
  Payload ID: 5134
  Gene Symbol: DYNAP
  Gene Name: dynactin associated protein
  Uniprot ID: Q8N1N2
  ENST ID: ENST00000321600
  CDS Start-End: 47-679
gtactgatgcatcatagttgacttccaccagtgttttaattgtttcatggttgcagatataaagggcaatgaacaaattgaaaaatattcttggagagaagcttgtgatactggcagctcaagaatggacagaaagcatggaaaatacatattgaacgttgagcactctgaaaaccagccgccaatcacacatccaaatgaccaagaggctcacagttccatatgctggtgtctaccttcaaatgatataaccagtgatgtctctcccaacttaactggggtctgcgtgaacccaggaatccttgcacattcaagatgtctacagtcagaatcctgtaacacacaggtaaaagaatattgccgcaatgactggtctatgtggaaagtcttcctggcttgtctcttagcctgtgtgataatgacagcaattggagtacttataatatgcttggtgaataacaaaggatcggccaattcctccattgttatccagctatccacaaatgatggagagtgtgtgactgtcaaacctggaacaccctctcctgcttgtccacctacaatgaccaccacttcaactgtacctgcaagtacagccactgaatctacaacttcaacagctacagctgccaccacttccacagaacctataactgttgcacctaccgatcatttataatttgaacagccatagccatcacttcaactgaaacttcaacctctaccacttcaactcagtttgcaactataatagctactcctatcacttcaagtggaatcatggctgcagtcactttaacagactctataaccgttacaacttcaacaaaatcaagtcctacttcaacttaaacttacttgacaactcaaataatcaccacttcgaccatctctttgactgaatcaacaactacattcccttcaactgaatctgcaaccacttccacttaacctataactactgtaacttctacttagcctacagtaacaatgctcatcactcttttccaacaatgtataatctccacctattcatctgaggactaagctctgatttttcatcttgcccaaattcctttctaaggggtatggggagtcatgccctacaaaccataaattctcatcagatgggttttatttaaccctgtatattgtgacttactttctaatctgactctggcataacaagggaaaaaaatcaaaatgttttaccccaaaatatatttccttgccataccttgaaattgtcctgcaaagtctcttgtggagaaactccacattctgtagagaatatcctttcccctttgttttccttcctttctttccagatccaggagataatcaactaagagccaggcacccttttaggtctaataagaaacactttacaacctgctctctctctgaagtctgctttctgagagattcctctgcacaataaaacttgatctccacaatcctttatcttaacctgaacattcctttccatggatctcaggtcttcagataaactaaaccaattgtcaaccagaacatgtttaaatttacctatagcctggaagccccaactttgagttgtcctgcctttctgaaccaagccaatgtatttcttaaatgtatttgattgatgtctcatgtctccctaaaaatatataaaaccaaactgtaccttagccactttggacacatgttctcaggacctcctgagggctatgtcatgagccatggtcactcatatttggctcagaattaatctcttaaaatattttacagagtttgactctttttgtcaacacatccgaacctgcaactacaaatgccaccattaccacttaaaacttgatagaactagcatcagtcatcaaaataacctgttctatattaagttaacttttagttatcaccagtaatactagcctacaactactcgccacactggctcttccccaaaattgaaattgtacaatatgtgagtctaattcttgctaacataacattattgcctacattaaaagcttctgcaaagc

SEQ ID NO: 128384 - DNA, 1102 bp, Homo sapiens
  Payload ID: 5134
  Gene Symbol: DYNAP
  Gene Name: dynactin associated protein
  ENST ID: ENST00000585973
  CDS Start-End: 92-568
aggaggatcagggtgtaagtcagccagagagacaaggaaaattttggatctataggagaaagaactttcaaacagcaaaagtcacccaaaaatggaataccaacttctagatataaagggcaatgaacaaattgaaaaatattcttggagagaagcttgtgatactggcagctcaagaatggacagaaagcatggaaaatacatattgaacgttgagcactctgaaaaccagccggtaaaagaatattgccgcaatgactggtctatgtggaaagtcttcctggcttgtctcttagcctgtgtgataatgacagcaattggagtacttataatatgcttggtgaataacaaaggatcggccaattcctccattgttatccagctatccacaaatgatggagagtgtgtgactgtcaaacctggaacaccctctcctgcttgtccacctacaatgaccaccacttcaactgtacctgcaagtacagccactgaatctacaacttcaacagctacagctgccaccacttccacagaacctataactgttgcacctaccgatcatttataatttgaacagccatagccatcacttcaactgaaacttcaacctctaccacttcaactcagtttgcaactataatagctactcctatcacttcaagtggaatcatggctgcagtcactttaacagactctataaccgttacaacttcaacaaaatcaagtcctacttcaacttaaacttacttgacaactcaaataatcaccacttcgaccatctctttgactgaatcaacaactacattcccttcaactgaatctgcaaccacttccacttaacctataactactgtaacttctacttagcctacagtaacaatgctcatcactcttttccaacaatgtataatctccacctattcatctgaggactaagctctgatttttcatcttgcccaaattcctttctaaggggtatggggagtcatgccctacaaaccataaattctcatcagatgggttttatttaaccctgtatattgtgacttactttctaatctgactctggcataacaagggaaaaaaatcaaaatgttttacc

SEQ ID NO: 128385 - DNA, 3254 bp, Homo sapiens
  Payload ID: 5135
  Gene Symbol: DNM1
  Gene Name: dynamin 1
  Uniprot ID: Q05193
  ENST ID: ENST00000341179
  CDS Start-End: 93-2648
agtctgggcgcgcggctgcagcggcggagccggagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagaatcactatcagtgacccctgaggagcgtcagccatgccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaa

SEQ ID NO: 128386 - DNA, 3244 bp, Homo sapiens
  Payload ID: 5135
  Gene Symbol: DNM1
  Gene Name: dynamin 1
  Uniprot ID: Q05193
  ENST ID: ENST00000372923
  CDS Start-End: 120-2714
gaggggcgggggccccgcggcgcaggcagtctgggcgcgcggctgcagcggcggagccggagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaa

SEQ ID NO: 128387 - DNA, 3245 bp, Homo sapiens
  Payload ID: 5135
  Gene Symbol: DNM1
  Gene Name: dynamin 1
  Uniprot ID: Q05193
  ENST ID: ENST00000393594
  CDS Start-End: 84-2639
gcgcggctgcagcggcggagccggagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagaatcactatcagtgacccctgaggagcgtcagccatgccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaa

SEQ ID NO: 128388 - DNA, 2710 bp, Homo sapiens
  Payload ID: 5135
  Gene Symbol: DNM1
  Gene Name: dynamin 1
  Uniprot ID: Q05193
  ENST ID: ENST00000475805
  CDS Start-End: 93-2648
agtctgggcgcgcggctgcagcggcggagccggagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagaatcactatcagtgacccctgaggagcgtcagccatggaagggcccagcctcacctacgagacctgcagccccccgaccagctg

SEQ ID NO: 128389 - DNA, 3181 bp, Homo sapiens
  Payload ID: 5135
  Gene Symbol: DNM1
  Gene Name: dynamin 1
  Uniprot ID: Q05193
  ENST ID: ENST00000486160
  CDS Start-End: 57-2651
cggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaa

SEQ ID NO: 128390 - DNA, 672 bp, Homo sapiens
  Payload ID: 5135
  Gene Symbol: DNM1
  Gene Name: dynamin 1
  ENST ID: ENST00000482638
  CDS Start-End: 1-395
acgaactgtcagggggagcccgcattaaccgaatcttccacgagcgcttccctttcgagctggtcaagatggagtttgatgagaaggaactccgaagggagatcagctatgctatcaagaatatccatggcattaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaagctggcggaacatcctggaaatgttcagaggcagccagaatggaaaaagatgctcaaaggggacagaacttctcaaaggggtggaggctgccctgccatgggtgacacgtggaaaacttgagacatgtgacatccaggcgctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatatt

SEQ ID NO: 128391 - DNA, 2724 bp, Homo sapiens
  Payload ID: 5135
  Gene Symbol: DNM1
  Gene Name: dynamin 1
  ENST ID: ENST00000627061
  CDS Start-End: 55-2562
gagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattaggacgggcctcttcacacctgacctcgcttttgaagccacagtgaaaaagcagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaa

SEQ ID NO: 128392 - DNA, 3835 bp, Homo sapiens
  Payload ID: 5135
  Gene Symbol: DNM1
  Gene Name: dynamin 1
  ENST ID: ENST00000628346
  CDS Start-End: 75-2669
cagcggcggagccggagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagcaggaagggcccagcctcacctacgagacctgcagccccccgaccagctgaggctcccctcttagacttataagtctatggccactggcatccggctgcctgccctccctgcctcccccagggtcccttcagagggtcctgggttttctgaacacccagaggggcctccggcgctccctccagccatcccttttagtttcaccctcctggttcaagcagtgttctttctctatcaggcctggtggctgttgcatggggctccccaaggcaaggggtggccccaggccagtgggttggaagacagggtgaccagagaagagggaagcccgagggggccgagcatcagcctgaattgcgggtgccctgcctgggtgccgtgtgagaggccagcgtgtgtggggtggggagggccgccacagcccccaggcgctatctgtgaagctacggctcctccctccatcttcctcccctttcccttccagccccttttccaggaaccttgccacacccacacctgcagcctcccctccccggccctcccaccactgctgcggcgcggccggccccggccgtgtgctgcgcttgccttaccagctctctcctcgcttttctctcccgttttctctctgctttctctccaactgccagccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaa

SEQ ID NO: 128393 - DNA, 333 bp, Homo sapiens
  Payload ID: 5135
  Gene Symbol: DNM1
  Gene Name: dynamin 1
  ENST ID: ENST00000625457
  CDS Start-End: 1-161
ctcctgggcctccgcctgctgggtccgccctggggggggcgccccccgtgccctccaggccgggggcttcccctgaccctttcggccctccccctcaggtgccctcgcgccccaaccgcgccccgcccggggtccccagaatcactatcagtgacccctgaggagcgtcagccatgcaggaagggcccagcctcacctacgagacctgcagccccccgaccagctgaggctcccctcttagacttataagtctatggccactggcatccggctgcctgccctccctgcctcccccagggtcccttcagagggtcctgggttttctgaacaccc

SEQ ID NO: 128394 - DNA, 4734 bp, Homo sapiens
  Payload ID: 5135
  Gene Symbol: DNM1
  Gene Name: dynamin 1
  Uniprot ID: Q05193
  ENST ID: ENST00000627543
  CDS Start-End: 55-2610
gagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagaatcactatcagtgacccctgaggagcgtcagccatggtaggtacatgcctcaccgcctgctgcatgaacggtgtgtctgccccgctgcactagctccacacggggcgcgcacctgggacctcagagccaggctccccgcccctcccttctgcagctgcagacttgctctttcctctttctgtccttgtgccgctggctctctcacctcccttccctgcgagcctcgggactcagtgccactgcccaaggcctccatggctgagcctggaggctcttggaacaggctccgcgcccaagctggcagacatgggtgctctctggagccgtcagagagggcagagagctcgtggtttatggtgtaaaggctgggagcttggagggggtcgtgtgtggggctggactctgaggcggccagaggcctaggaacgttatcctgggcacaccgtgcgtggtgtgcagtctgagtcatgctccctgggtagggcatccagctcccagcctgggagtgctgagagccaaatccaccgtagagcaggggtgagagtcagggtcccacctcctctatctgccggcaatccagtggtgacctagggtaaaagcttgagagtcccatacacacggtcatcccacgacatacctcacaggccaggcagggacacacagcccccttccctccctcccaggtaccgtcatagctgctagtgtgactgaaggcagtgtccctggccccagctgaagcaccgtagccagccagcgggctcacgcaccttggcctgttgctcctagggtcacttgtgccattcagccaaggggacgaccgtgcctgctggcccagctgagctccgcccagtgagcccaccccccattctcctgccactgactctcgctcttctgcttttcccagcaggaagggcccagcctcacctacgagacctgcagccccccgaccagctgaggctcccctcttagacttataagtctatggccactggcatccggctgcctgccctccctgcctcccccagggtcccttcagagggtcctgggttttctgaacacccagaggggcctccggcgctccctccagccatcccttttagtttcaccctcctggttcaagcagtgttctttctctatcaggcctggtggctgttgcatggggctccccaaggcaaggggtggccccaggccagtgggttggaagacagggtgaccagagaagagggaagcccgagggggccgagcatcagcctgaattgcgggtgccctgcctgggtgccgtgtgagaggccagcgtgtgtggggtggggagggccgccacagcccccaggcgctatctgtgaagctacggctcctccctccatcttcctcccctttcccttccagccccttttccaggaaccttgccacacccacacctgcagcctcccctccccggccctcccaccactgctgcggcgcggccggccccggccgtgtgctgcgcttgccttaccagctctctcctcgcttttctctcccgttttctctctgctttctctccaactgccagccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaatg

SEQ ID NO: 128395 - DNA, 3248 bp, Homo sapiens
  Payload ID: 5135
  Gene Symbol: DNM1
  Gene Name: dynamin 1
  ENST ID: ENST00000634267
  CDS Start-End: 120-2690
gaggggcgggggccccgcggcgcaggcagtctgggcgcgcggctgcagcggcggagccggagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagccagccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaa

SEQ ID NO: 128396 - DNA, 3101 bp, Homo sapiens
  Payload ID: 5136
  Gene Symbol: DNM1L
  Gene Name: dynamin 1-like
  Uniprot ID: O00429
  ENST ID: ENST00000266481
  CDS Start-End: 62-2161
gggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttt

SEQ ID NO: 128397 - DNA, 3229 bp, Homo sapiens
  Payload ID: 5136
  Gene Symbol: DNM1L
  Gene Name: dynamin 1-like
  ENST ID: ENST00000358214
  CDS Start-End: 73-2211
aggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatgaccctgctacatggaaaaactcaagacacctttctaaaggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacc

SEQ ID NO: 128398 - DNA, 4397 bp, Homo sapiens
  Payload ID: 5136
  Gene Symbol: DNM1L
  Gene Name: dynamin 1-like
  Uniprot ID: O00429
  ENST ID: ENST00000381000
  CDS Start-End: 42-2258
gccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatgaccctgctacatggaaaaactcaagacacctttctaaaggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgacact

SEQ ID NO: 128399 - DNA, 1008 bp, Homo sapiens
  Payload ID: 5136
  Gene Symbol: DNM1L
  Gene Name: dynamin 1-like
  ENST ID: ENST00000434676
  CDS Start-End: 45-515
attgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcg

SEQ ID NO: 128400 - DNA, 1064 bp, Homo sapiens
  Payload ID: 5136
  Gene Symbol: DNM1L
  Gene Name: dynamin 1-like
  ENST ID: ENST00000413295
  CDS Start-End: 45-587
attgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctg

SEQ ID NO: 128401 - DNA, 4211 bp, Homo sapiens
  Payload ID: 5136
  Gene Symbol: DNM1L
  Gene Name: dynamin 1-like
  Uniprot ID: O00429
  ENST ID: ENST00000414834
  CDS Start-End: 370-1971
agcgcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatgaccctgctacatggaaaaactcaagacacctttctaaaggggtggaagcagaagaatggggtaaatttcttcacaccaaaaataaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgacactaaagtttgtcaaaaaatgaattcttaacttttctcccagagaaagggagacaaaaggagctttttaatacctaatctactttggaacataaccgtatagag

SEQ ID NO: 128402 - DNA, 4439 bp, Homo sapiens
  Payload ID: 5136
  Gene Symbol: DNM1L
  Gene Name: dynamin 1-like
  Uniprot ID: O00429
  ENST ID: ENST00000452533
  CDS Start-End: 165-2297
agcgcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgacactaaa

SEQ ID NO: 128403 - DNA, 550 bp, Homo sapiens
  Payload ID: 5136
  Gene Symbol: DNM1L
  Gene Name: dynamin 1-like
  ENST ID: ENST00000550154
  CDS Start-End: 45-550
attgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaac

SEQ ID NO: 128404 - DNA, 813 bp, Homo sapiens
  Payload ID: 5136
  Gene Symbol: DNM1L
  Gene Name: dynamin 1-like
  ENST ID: ENST00000548750
  CDS Start-End: 29-813
ggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacag

SEQ ID NO: 128405 - DNA, 560 bp, Homo sapiens
  Payload ID: 5136
  Gene Symbol: DNM1L
  Gene Name: dynamin 1-like
  ENST ID: ENST00000551476
  CDS Start-End: 45-560
attgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagagaccctgctacatggaaaaactcaagacacctttctaaaggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaataca

SEQ ID NO: 128406 - DNA, 2661 bp, Homo sapiens
  Payload ID: 5136
  Gene Symbol: DNM1L
  Gene Name: dynamin 1-like
  ENST ID: ENST00000546757
  CDS Start-End: 1-165
agcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatgctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaa

SEQ ID NO: 128407 - DNA, 2393 bp, Homo sapiens
  Payload ID: 5136
  Gene Symbol: DNM1L
  Gene Name: dynamin 1-like
  Uniprot ID: O00429
  ENST ID: ENST00000547312
  CDS Start-End: 45-2222
attgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacat

SEQ ID NO: 128408 - DNA, 450 bp, Homo sapiens
  Payload ID: 5136
  Gene Symbol: DNM1L
  Gene Name: dynamin 1-like
  ENST ID: ENST00000547078
  CDS Start-End: 1-146
agcactgtagcaattacagtacacaggaattgttacgatttcctaaacttcatgatgccatagttgaagtggtgacttgtcttcttcgtaaaaggttgcctgttacaaatgaaatgtgcatttgggtccttggctcaggatggtgaaccccgtggaggtttactaagagtacaaaaccatccttggaatgtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaat

SEQ ID NO: 128409 - DNA, 2097 bp, Homo sapiens
  Payload ID: 5136
  Gene Symbol: DNM1L
  Gene Name: dynamin 1-like
  ENST ID: ENST00000546649
  CDS Start-End: 45-398
attgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatgaccctgctacatggaaaaactcaagacacctttctaaaggggtggaagcagaagaatggggtaaatttcttcacaccaaaaataaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacag

SEQ ID NO: 128410 - DNA, 2699 bp, Homo sapiens
  Payload ID: 5136
  Gene Symbol: DNM1L
  Gene Name: dynamin 1-like
  Uniprot ID: O00429
  ENST ID: ENST00000553257
  CDS Start-End: 78-2327
gaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatgaccctgctacatggaaaaactcaagacacctttctaaaggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctcc

SEQ ID NO: 128411 - DNA, 2487 bp, Homo sapiens
  Payload ID: 5136
  Gene Symbol: DNM1L
  Gene Name: dynamin 1-like
  Uniprot ID: O00429
  ENST ID: ENST00000549701
  CDS Start-End: 75-2285
ggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaa

SEQ ID NO: 128412 - DNA, 538 bp, Homo sapiens
  Payload ID: 5136
  Gene Symbol: DNM1L
  Gene Name: dynamin 1-like
  ENST ID: ENST00000551643
  CDS Start-End: 45-338
attgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatgttccaagggaaaacagtcttgaccctgggggaaaatcaccttgaaagtgtgtgtaaattacaaagcagctagctctataataatgagagagctctttaaaggaacagcaagttgtggctctacaggggtggaagcagaagaatggggtaaatttcttcacaccaaaaataagctttacacggattttgatgaaattcgacaagaaattgaaaatgaaacagaaagaatttcaggaaataataag

SEQ ID NO: 128413 - DNA, 3541 bp, Homo sapiens
  Payload ID: 5137
  Gene Symbol: DNM2
  Gene Name: dynamin 2
  Uniprot ID: P50570
  ENST ID: ENST00000355667
  CDS Start-End: 81-2693
cagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcagggggagatcctggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgc

SEQ ID NO: 128414 - DNA, 3588 bp, Homo sapiens
  Payload ID: 5137
  Gene Symbol: DNM2
  Gene Name: dynamin 2
  Uniprot ID: P50570
  ENST ID: ENST00000359692
  CDS Start-End: 151-2751
gcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataa

SEQ ID NO: 128415 - DNA, 3581 bp, Homo sapiens
  Payload ID: 5137
  Gene Symbol: DNM2
  Gene Name: dynamin 2
  Uniprot ID: P50570
  ENST ID: ENST00000389253
  CDS Start-End: 113-2725
ccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcagggggagatcctggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 128416 - DNA, 3013 bp, Homo sapiens
  Payload ID: 5137
  Gene Symbol: DNM2
  Gene Name: dynamin 2
  Uniprot ID: P50570
  ENST ID: ENST00000408974
  CDS Start-End: 36-2636
agcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggca

SEQ ID NO: 128417 - DNA, 868 bp, Homo sapiens
  Payload ID: 5137
  Gene Symbol: DNM2
  Gene Name: dynamin 2
  ENST ID: ENST00000587830
  CDS Start-End: 1-868
cgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaactgttactatactgagcagctggtgacctgtgcccagcagaggagcacgcagctgaacaagaagagagccatccccaatcaggtgatccgcaggggctggctgaccatcaacaacatca

SEQ ID NO: 128418 - DNA, 538 bp, Homo sapiens
  Payload ID: 5137
  Gene Symbol: DNM2
  Gene Name: dynamin 2
  ENST ID: ENST00000591818
  CDS Start-End: 1-510
ccagttcggatccccccagggattcccccaggagtgcccaggggctacgtgggcaccgggcgcttgtcctggaagaagcgcttgagcgtgcagacctgcagcacagccaccagcagcagcaccgccacgttgacagctgaccagaagttgacccgctccaagttgccctcttgcaggttgcggtcacgtgcctcgaaggcccgcagtagcgtgagcatctggatgctgcgctccagccgggtccgcatggtctcaatggactcctacagggcagcgggaggggaagggtcaggcctccctccacccatcagggagcagagaccaaaaaaaccgggggatacggagggaggctgtattaaccctgggaggtacagctgcaaacacagacttgttcaggctaagttcaaatcctcaccctgccactcactggctgtgaccatgagcaacttaattaacctatctgagcctgtttcctcttctataagcttccaaattgctgtgaacatttaatgcctaaataaatgtacaaggatgagca

SEQ ID NO: 128419 - DNA, 565 bp, Homo sapiens
  Payload ID: 5137
  Gene Symbol: DNM2
  Gene Name: dynamin 2
  ENST ID: ENST00000589106
  CDS Start-End: 1-413
cggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccaggtaaggccaaccccctgccctccaccccaactgcctgcaccctggggtctctcctcctgtctcacttcctcccagtgagctctcactacgtgcccagctgctggagtggaggaatcgtcctcatccctatttggcttgcgaggaaacaggcccaga

SEQ ID NO: 128420 - DNA, 551 bp, Homo sapiens
  Payload ID: 5137
  Gene Symbol: DNM2
  Gene Name: dynamin 2
  ENST ID: ENST00000586939
  CDS Start-End: 400-551
ctgggcagaggactccctgcaggggctccggagcaggcccgggccccaggggcggtgtcacgggccagggcgccgtaggacaggagggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacct

SEQ ID NO: 128421 - DNA, 2774 bp, Homo sapiens
  Payload ID: 5137
  Gene Symbol: DNM2
  Gene Name: dynamin 2
  Uniprot ID: P50570
  ENST ID: ENST00000585892
  CDS Start-End: 165-2774
gagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcagggggagatcctggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagaagaccccctgctgcgcccagccggcccaccattatccgcccagccgagccatccctgctcgactag

SEQ ID NO: 128422 - DNA, 3280 bp, Homo sapiens
  Payload ID: 5138
  Gene Symbol: DNM3
  Gene Name: dynamin 3
  Uniprot ID: Q9UQ16
  ENST ID: ENST00000355305
  CDS Start-End: 158-2767
agccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcagggactttctccctcgagggtcgggcattgtaacaagacgacctcttgtgctgcagcttgttacttctaaagcagaatatgccgagtttctacattgcaaaggaaagaaatttacagattttgatgaagttcgccttgagattgaagcagaaacagatcgcgtgactggaatgaataaaggcatttcctccatacccattaatttacgagtctattccccacacgtgttaaatctaacccttattgatctacctggaataactaaagtgcctgtgggagatcagccaccagatatcgagtatcagatcagagaaatgattatgcagttcatcacgagggagaactgtctgattttagctgttactccagccaacactgatcttgcaaactcagatgcgctgaagctagctaaagaagttgatcctcaaggtctgagaaccattggagttatcaccaaactggaccttatggatgaaggaacggatgccagggatgttctagagaacaaactgttgcctcttcgcaggggttacgtgggggtggtaaacagaagccagaaggacatagatgggaagaaggacataaaggcagccatgctggcagagaggaagtttttcctttcccacccggcttacagacatatcgctgaccgaatgggaaccccacacctgcagaaggtccttaatcagcaacttaccaaccacattcgggataccctaccaaacttcaggaacaaactacagggacagttgctctccatagaacatgaagtagaagcctacaaaaatttcaaaccagaagacccaacaaggaagaccaaagcattgctgcagatggttcagcaatttgctgtggactttgagaagagaattgaagggtcaggggatcaagtagataccctggaactctcaggtggtgctaaaatcaatcgtatttttcatgaacgctttccttttgagatagtaaagatggagttcaatgagaaagaattgcgaagagaaataagctatgcaatcaaaaacatacatggtatcaggacagggttgtttactccagacatggcatttgaagcgatagtcaagaaacagattgtaaagttgaaagggccttccttgaagagtgtggatctggtaatacaagaattaatcaacactgtgaagaagtgtaccaaaaaactggcaaacttccccagactctgcgaggaaacggaaaggattgttgctaaccacattcgtgagcgagaagggaagacaaaggaccaggtattgctattgattgacattcaagtctcttacatcaacaccaaccatgaagacttcattggcttcgcaaatgctcagcagaggagcagtcaggttcacaagaaaaccacagttggaaatcagggaaccaatcttccgccttcaaggcaaattgtgattcgcaaggggtggctcaccatcagcaacattggcatcatgaaaggcggctcgaagggatactggttcgtccttactgcggaaagcttgtcctggtataaagatgatgaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacagccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaagccggagaccacccccatcaccaactcgtcccactataatccgcccactagaatcctccctgttagactaaacgaagtgtctggcatggcaattaatcactaatgaattatgcgaaagcaacatatttgataaccgttgcagtaaatcatgagtagtcgcatgtgtggacatcagtaggcaagtaaccagttttactaatgcattcatcgctcatcttcattgctcatggtatgtcaaacctttggggtttgactcagaaactgctaaccttttagaggctttatatgttgtactgaccaaggtaggtttgtatagcagccctatactttggggatcatttgcctaccatggcatatatttgaaattgctttggacaagttttctaggctatctaccaggtagctcattaaacgtaattcttcagatatgagatagtgggcttagacctaagccatacatatttcttttcccacattctgtttaggatgacagtaattctgttgtctaccattaatgctactacctactccataattgcctatttagctcctcttttcttcctttttatttcataagactgcta

SEQ ID NO: 128423 - DNA, 7613 bp, Homo sapiens
  Payload ID: 5138
  Gene Symbol: DNM3
  Gene Name: dynamin 3
  Uniprot ID: Q9UQ16
  ENST ID: ENST00000367731
  CDS Start-End: 158-2737
agccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcagggactttctccctcgagggtcgggcattgtaacaagacgacctcttgtgctgcagcttgttacttctaaagcagaatatgccgagtttctacattgcaaaggaaagaaatttacagattttgatgaagttcgccttgagattgaagcagaaacagatcgcgtgactggaatgaataaaggcatttcctccatacccattaatttacgagtctattccccacacgtgttaaatctaacccttattgatctacctggaataactaaagtgcctgtgggagatcagccaccagatatcgagtatcagatcagagaaatgattatgcagttcatcacgagggagaactgtctgattttagctgttactccagccaacactgatcttgcaaactcagatgcgctgaagctagctaaagaagttgatcctcaaggtctgagaaccattggagttatcaccaaactggaccttatggatgaaggaacggatgccagggatgttctagagaacaaactgttgcctcttcgcaggggttacgtgggggtggtaaacagaagccagaaggacatagatgggaagaaggacataaaggcagccatgctggcagagaggaagtttttcctttcccacccggcttacagacatatcgctgaccgaatgggaaccccacacctgcagaaggtccttaatcagcaacttaccaaccacattcgggataccctaccaaacttcaggaacaaactacagggacagttgctctccatagaacatgaagtagaagcctacaaaaatttcaaaccagaagacccaacaaggaagaccaaagcattgctgcagatggttcagcaatttgctgtggactttgagaagagaattgaagggtcaggggatcaagtagataccctggaactctcaggtggtgctaaaatcaatcgtatttttcatgaacgctttccttttgagatagtaaagatggagttcaatgagaaagaattgcgaagagaaataagctatgcaatcaaaaacatacatggtatcaggacagggttgtttactccagacatggcatttgaagcgatagtcaagaaacagattgtaaagttgaaagggccttccttgaagagtgtggatctggtaatacaagaattaatcaacactgtgaagaagtgtaccaaaaaactggcaaacttccccagactctgcgaggaaacggaaaggattgttgctaaccacattcgtgagcgagaagggaagacaaaggaccaggtattgctattgattgacattcaagtctcttacatcaacaccaaccatgaagacttcattggcttcgcaaatgctcagcagaggagcagtcaggttcacaagaaaaccacagttggaaatcaggtgattcgcaaggggtggctcaccatcagcaacattggcatcatgaaaggcggctcgaagggatactggttcgtccttactgcggaaagcttgtcctggtataaagatgatgaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacagccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaagccggagaccacccccatcaccaactcgtcccactataatccgcccactagaatcctccctgttagactaaacgaagtgtctggcatggcaattaatcactaatgaattatgcgaaagcaacatatttgataaccgttgcagtaaatcatgagtagtcgcatgtgtggacatcagtaggcaagtaaccagttttactaatgcattcatcgctcatcttcattgctcatggtatgtcaaacctttggggtttgactcagaaactgctaaccttttagaggctttatatgttgtactgaccaaggtaggtttgtatagcagccctatactttggggatcatttgcctaccatggcatatatttgaaattgctttggacaagttttctaggctatctaccaggtagctcattaaacgtaattcttcagatatgagatagtgggcttagacctaagccatacatatttcttttcccacattctgtttaggatgacagtaattctgttgtctaccattaatgctactacctactccataattgcctatttagctcctcttttcttcctttttatttcataagactgctaggaagtgattttttaaaattaggactccttaagaataaacttttccagaagcacgaggtagtttgcaaaggaaaagtctgcactgtttgctctaaagagcttctcctcattccaatgtgttttgcttcatgctagaagcatatgcaacagtgaataaaagcttctttttttgttaatcagtcaataaatttggctaattagtttcagagttcaaggaagaagcaaaatatcacatctctagaagtgttgggaaaaatataatttctttctttacttatattcacctcatggtaggttatattgaaggctgacatggagaatgtttacttttctatttggcatagctaactacactttgatactaactccagttttactattattattttggttggaaaaaaaattcactctttacgtgctaatttgtaatcttgttttgtaagaatttatcctacccttgaaacaggctcagtgtaactgtatatccattctaggctttcttaataaatcttgaggctatgggataatcacatttaaagaatggttcctgaaatgaagtcagtagaaatggcatgggataagagcagagctcacacttttacagttgcagtatttcaaagtccctatccaggtcactccagaaaagggtattgaaacgttgaaatctaaagcaaatttgcaatttcttaagatttctaaaatttaccagaacagtttagcctgggggttaatagttaagtcttgaggctaagttttggactaccaaggaccagatgattcacatgtaggaaacagccagaagccaactggaattttgtgtgctaactgttcccagacagcagagcaagtattcactgagtaggggtgtcccatgacactatttcatattctacagaagtaaatcaggtttcaccaactgaaatgtctccctttgaaagtagcaaacatgatttgtatgttaacttaactttaatttcctgtgtagtttacacccagagcagatactcataaagtataaagtaaaaacttttaaccattattaaacagagaacttgccatgttgagtgccattgtattgaacttattctaaaggcttatgctaacccatttataattggtaaaaatcagaaaatacaagatttacataaaggtcatttcaacttttaaggttaccagtgattgtataaaaacatcacaatcctaaatcctctcgtatctcaccccaaaccccaaactgggggaaaaaaagttaactctttgtgaatggaaccaatgtgcaagatacatactgcatttttaaaatagtgtctcagctaaatggaaaactgttaagcaaacatccatagtaaaacaaataatcttcagtgagatctttttataaaacttcttgtttttaggattccctttgcttcttcctttgaattctctaaaataggcagctaacggattatatacttcagggtttggctttgtgctaaatgtggttttgtgttttgctgtatttcaaaattttccttctgttaaaggaaaatattgtgaataaccactggtgtgttcttagatcagcacaaaccatgtcaaaaaaaattggagatttttttccaattttccttccactgatcttaggcagtaataaacaatggcatttgtcatctttggcacttgcttttagattatagtcccacagttgcactgccccaattgtctacctttgtgggtacatttttgttctttactcctaagttatttctcatagaacccagcctactctagaatttcagcagtgacattggagaatatttttaatttgctgcagtactatgtcatattattagtatgaatctcatttcccaaagggtttgtattctgctaaaaggagatgccaatgttgaatgaagtctgaaactctagtatgtgcatagtttgacgtgcagcatgcacaccaggccttaagatgggaatgtagcttaatgattttctgtttcccataccatttctaatcttttgtgtaattttctcttaactgattgctctgatattgtaaacacaatagatgtagctctatcatgtctagcataatttaaaaaatcagtgtttttaggatttgggaaaataaactgtaaatgtttatttgataggtaaatatagttttattgtcacatgctaaatattgcatgcatattgactaattggaataaccatttactcaattatggacagcttattgaaatagtattgatttagaaaaagtatattgcatttctaaaaaacatctaccaaggttactcgtctgaatattgcttttagccgtgttttataacatagacgagcagtagggtctgtttattagcaaatttcctatttgttccaatacaaactcactttattctaaagtatattaatgaaaccagttcctgtgatgtaactgtaagccttctcgacttagacttaaaaagtggtcacatagattaattttgtgactttttagtatagactgtagccataattctcaaatatgaaatgggacctaataccagtatgtgataaatgttgatgttttctgtgtacaaacacattttctatgcatgtgtctctgtgtatatggcatatacctagtaagtatgtttctgtaagtatgtgtattttatgtccatttgagtaggtaggtaggttttaaaaatactagttaaaatgccacaagcatgagtgtgattgtatgtgcactgtgtgtatatatataaatatatgtatatgtatggttgtaaatatctatgtatacatgtacttagtatgtgtggtatcaggatattttttaaactgtgataatacaacagatagctttgaatgatctgccataacatgtggtaacaatagttcatttctcataacatatatgaggtatacaaaattttctaactccagattgtagtcattttgagaggtacaaagctcataattaccatgacaacatggtaatgtccatagacatttgtatctgaatccacaagaagatctgaatctaagaaggaattacctttgacaatatttttcggtaagaagtaaaacctctggagacctatctttaagatctctaattggaattataaattatttttggattgctgagctgaatcttaaaaagccaagttgatatacatagtcatttttcctctatggtagaagtaaaaaaaaaaaaaaaggacatagcaacattaaagtagtggatttttctgagtaaatttgctgaaaatataagagagaagctatctaataccttggaggtaggtcatccactttttcaggtaaacatttttcatttggcaaatggcataattatttgaaagtgacaggaatctcctcagaatgaagaataaagcctactaggtctctaactgttgaactcatgaaagaagatagtgtatgagacttaagccatgagttttgtatcatttcaattagaagactactagctgtgagctcagagtttaatgtaaatgaatctagatgattttgaagaaatgattattcgttcaccagatcactcattgtacattctaaaaagctcaaatgagtcttctagatactcttactcatcctgtctggttgctatgtttaaaattatgtggtgctgtgtaggtgaaactttaagaatatttttgaagcatatgtaatatatgcactgctatttgtgtgtgtgtgtgtgtctttgtatatatgtaagaatgtgtgtatgtgtgagagcaagagagaggaaactcaaagaggagtgtttgtcttaagacctgttcatactggtatattggtgagacttctcacttctggttggaggtttcacatatggctcaactcaagtcattaatctctttttaatttttactcttgaattccttaaacttcgctcattatgaaatgttttaaaattatgacaaaaattactctgtctaaccacttgccttgtctgctaccagtttgttaaaaattattccccccaaccagtaattccaccagtactacttgatttgtgttatatttcctatgtacatgtacagcctttgttttgcttgcttgtctatttttactttcccttttttgggtcaaatttttcttttgctttgtttgaagaaggaatatacagaagtaaaatcttgtcttctctgctgattctttaattaatatgagccggatactttccactgtcttcttggcactttcaggatttcttaatgctgatatatggactcttagaatggaatttttgaagaaaaatctcaaagcctgtatcgttcttgaaggtcacatgtacctattgtgaaaatgtgaagctgtatttctgaagctgaaataaattataacatttgaagga

SEQ ID NO: 128424 - DNA, 2322 bp, Homo sapiens
  Payload ID: 5138
  Gene Symbol: DNM3
  Gene Name: dynamin 3
  Uniprot ID: Q9UQ16
  ENST ID: ENST00000367733
  CDS Start-End: 160-1827
agagccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcagggactttctccctcgagggtcgggcattgtaacaagacgacctcttgtgctgcagcttgttacttctaaagcagaatatgccgagtttctacattgcaaaggaaagaaatttacagattttgatgaagttcgccttgagattgaagcagaaacagatcgcgtgactggaatgaataaaggcatttcctccatacccattaatttacgagtctattccccacacgtgttaaatctaacccttattgatctacctggaataactaaagtgcctgtgggagatcagccaccagatatcgagtatcagatcagagaaatgattatgcagttcatcacgagggagaactgtctgattttagctgttactccagccaacactgatcttgcaaactcagatgcgctgaagctagctaaagaagttgatcctcaaggtctgagaaccattggagttatcaccaaactggaccttatggatgaaggaacggatgccagggatgttctagagaacaaactgttgcctcttcgcaggggttacgtgggggtggtaaacagaagccagaaggacatagatgggaagaaggacataaaggcagccatgctggcagagaggaagtttttcctttcccacccggcttacagacatatcgctgaccgaatgggaaccccacacctgcagaaggtccttaatcagcaacttaccaaccacattcgggataccctaccaaacttcaggaacaaactacagggacagttgctctccatagaacatgaagtagaagcctacaaaaatttcaaaccagaagacccaacaaggaagaccaaagcattgctgcagatggttcagcaatttgctgtggactttgagaagagaattgaagggtcaggggatcaagtagataccctggaactctcaggtggtgctaaaatcaatcgtatttttcatgaacgctttccttttgagatagtaaagatggagttcaatgagaaagaattgcgaagagaaataagctatgcaatcaaaaacatacatggtatcaggacagggttgtttactccagacatggcatttgaagcgatagtcaagaaacagattgtaaagttgaaagggccttccttgaagagtgtggatctggtaatacaagaattaatcaacactgtgaagaagtgtaccaaaaaactggcaaacttccccagactctgcgaggaaacggaaaggattgttgctaaccacattcgtgagcgagaagggaagacaaaggaccaggtattgctattgattgacattcaagtctcttacatcaacaccaaccatgaagacttcattggcttcgcaaatgctcagcagaggagcagtcaggttcacaagaaaaccacagttggaaatcaggtgattcgcaaggggtggctcaccatcagcaacattggcatcatgaaaggcggctcgaagggatactggttcgtccttactgcggaaagcttgtcctggtataaagatgatgagaacatttagtcttggcgaggataaccaacttaccaaagtcacacagctagttggtggcaaagcagaaatttgaacccaggctgttgagctccagagcctatgctttcaaccacaaataaaggcaagaatcccagagatgcctggagttgtccaagccaacctcatcccacagaggacttatgaagatgaattccaggcatctcagcattgacatgttcctgggtgttagcagcagagacactgaagactctggagtagctactgctgttggagtgtggcattagtctggctctgtgagtcctgaaaataagcccattggaaggtataggatgctctctgtagggaaggaagaagctttgaaggcttggtgagctcttggttattggctcatctcctctcctccagactcaggataattctttacaaaatcactgcccttgtagcttccttatgagtacttgattacaacaaatggaaaataaatatgcacagttataatattaa

SEQ ID NO: 128425 - DNA, 815 bp, Homo sapiens
  Payload ID: 5138
  Gene Symbol: DNM3
  Gene Name: dynamin 3
  ENST ID: ENST00000485254
  CDS Start-End: 1-666
gctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacagccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaaggcgaccccctcctgcagttccaggacgaccatcctaacccccatcattcatctccttttgtttccaacaacatgtctatccatggtatttaaaagcttttcatttgcactatatgtcgtatgtacataaaaacttttatttttcatccatgtgtataataaaaacaaagtttattctatataaaaa

SEQ ID NO: 128426 - DNA, 1554 bp, Homo sapiens
  Payload ID: 5138
  Gene Symbol: DNM3
  Gene Name: dynamin 3
  ENST ID: ENST00000523513
  CDS Start-End: 220-1554
ctgcatcctactgctattttcattttatcgatggaatactttgaagcacgaaaaatcattatatcttgaaataatttttaaaataatccaataacaaactcagaactactgaagaataataaagaatatgccgagtttctacattgcaaaggaaagaaatttacagattttgatgaagttcgccttgagattgaagcagaaacagatcgcgtgactggaatgaataaaggcatttcctccatacccattaatttacgagtctattccccacacgtgttaaatctaacccttattgatctacctggaataactaaagtgcctgtgggagatcagccaccagatatcgagtatcagatcagagaaatgattatgcagttcatcacgagggagaactgtctgattttagctgttactccagccaacactgatcttgcaaactcagatgcgctgaagctagctaaagaagttgatcctcaaggtctgagaaccattggagttatcaccaaactggaccttatggatgaaggaacggatgccagggatgttctagagaacaaactgttgcctcttcgcaggggttacgtgggggtggtaaacagaagccagaaggacatagatgggaagaaggacataaaggcagccatgctggcagagaggaagtttttcctttcccacccggcttacagacatatcgctgaccgaatgggaaccccacacctgcagaaggtccttaatcagcaacttaccaaccacattcgggataccctaccaaacttcaggaacaaactacagggacagttgctctccatagaacatgaagtagaagcctacaaaaatttcaaaccagaagacccaacaaggaagaccaaagcattgctgcagatggttcagcaatttgctgtggactttgagaagagaattgaagggtcaggggatcaagtagataccctggaactctcaggtggtgctaaaatcaatcgtatttttcatgaacgctttccttttgagatagtaaagatggagttcaatgagaaagaattgcgaagagaaataagctatgcaatcaaaaacatacatggtatcaggacagggttgtttactccagacatggcatttgaagcgatagtcaagaaacagattgtaaagttgaaagggccttccttgaagagtgtggatctggtaatacaagaattaatcaacactgtgaagaagtgtaccaaaaaactggcaaacttccccagactctgcgaggaaacggaaaggattgttgctaaccacattcgtgagcgagaagggaagacaaaggaccaggtattgctattgattgacattcaagtctcttacatcaacaccaaccatgaagacttcattggcttcgcaaatgctcagcagaggagcagtcaggttcacaagaaaaccacagttggaaatcaggtgattcgcaaggggtggctcaccatcagcaacattggcatcatgaaaggcggctcgaagggatactggttcgtccttactgcggaaagcttgtcctggtataaagatgatgaggaaaaa

SEQ ID NO: 128427 - DNA, 4454 bp, Homo sapiens
  Payload ID: 5138
  Gene Symbol: DNM3
  Gene Name: dynamin 3
  ENST ID: ENST00000520906
  CDS Start-End: 129-2048
gacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcagggactttctccctcgagggtcgggcattgtaacaagacgacctcttgtgctgcagcttgttacttctaaagcagaatatgccgagtttctacattgcaaaggaaagaaatttacagattttgatgaagttcgccttgagattgaagcagaaacagatcgcgtgactggaatgaataaaggcatttcctccatacccattaatttacgagtctattccccacacgtgttaaatctaacccttattgatctacctggaataactaaagtgcctgtgggagatcagccaccagatatcgagtatcagatcagagaaatgattatgcagttcatcacgagggagaactgtctgattttagctgttactccagccaacactgatcttgcaaactcagatgcgctgaagctagctaaagaagttgatcctcaaggtctgagaaccattggagttatcaccaaactggaccttatggatgaaggaacggatgccagggatgttctagagaacaaactgttgcctcttcgcaggggttacgtgggggtggtaaacagaagccagaaggacatagatgggaagaaggacataaaggcagccatgctggcagagaggaagtttttcctttcccacccggcttacagacatatcgctgaccgaatgggaaccccacacctgcagaaggtccttaatcagcaacttaccaaccacattcgggataccctaccaaacttcaggaacaaactacagggacagttgctctccatagaacatgaagtagaagcctacaaaaatttcaaaccagaagacccaacaaggaagaccaaagcattgctgcagatggttcagcaatttgctgtggactttgagaagagaattgaagggtcaggggatcaagtagataccctggaactctcaggtggtgctaaaatcaatcgtatttttcatgaacgctttccttttgagatagtaaagatggagttcaatgagaaagaattgcgaagagaaataagctatgcaatcaaaaacatacatggtatcaggacagggttgtttactccagacatggcatttgaagcgatagtcaagaaacagattgtaaagttgaaagggccttccttgaagagtgtggatctggtaatacaagaattaatcaacactgtgaagaagtgtaccaaaaaactggcaaacttccccagactctgcgaggaaacggaaaggattgttgctaaccacattcgtgagcgagaagggaagacaaaggaccaggtattgctattgattgacattcaagtctcttacatcaacaccaaccatgaagacttcattggcttcgcaaatgctcagcagaggagcagtcaggttcacaagaaaaccacagttggaaatcaggtgattcgcaaggggtggctcaccatcagcaacattggcatcatgaaaggcggctcgaagggatactggttcgtccttactgcggaaagcttgtcctggtataaagatgatgaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagtaagttggatatatctcttatgtaaaaattattattagctatgcttaagaaaatattaatcctacataccataagctggagaaactagttttcttactgacttaattaattagttacacttttagctgatacttcgcttactctttttatattttttaacaatgctttttctctgttagatttctatttgaagaagttaaacaatatatttgttaaagaaaatgtcctactcagccataaaacacatatgcaatctcagctcaagacaaagtttgttttatttcaaaatttcatttttctctatatgctttttcatacttatcatggtattaatacaatcagtatatcatcaatcataacaccagcattttgacttgcttaaaatatactcattttaataaaaatctatcccctttcattatgtctatattccctgtatccataagtatatctgtgtgcaaactctgtttaatatcctcatgagtgtgaaagaacaaaaagaaatatattgctatttccacttgtctttattaatatgcttcacgtgtctttaagacacttctctcattcaagttaataaacagaccttttctttgtgttctttggaaaatgtaatattacacagactagtctaaatttaaacagaagtctcacccaacatatgtgcacccaccgttaaacagactctgccactgagtggacctctccacttgctgcttcctcctgtatatctagattatccaggtttctccccagaactaaagtactgagactaagccttggggatttagttcagcttaactcctgaggtgcctacttggctctcgatcagtttataggaatgatcatgcatgagttgggtcctttttaggttcaaaatagggagagagtcttttcaagagaaagtctgagatatgggtgaaacataggacaattaaagtatttctaggggggtttcagggctgaccacatctctggggttatactaaaatgtaacagagtttcaggaatacaggattgaggacttgcaccaaaatgtcgtcctctctgctgttattttaactcacacatagacctctttatgccattgcatgctatacttgtcatcctatacctgtctgacacctaaaacaatgaacctcccacaatatgctttgtgccctccaaatggaagttaaactagatgctttcctgtcaatagccaggagtacagaagcacgcatatatgattttcataattgttgtcgagttgttctcctgttatatgcgtagatatttgcatagatatataccactctaaagactacatgtgagaagtcattaaacatcagagtaccacttttacttttgtttttaactctattacttattactcttccctatccattgatggtagtgtgtttaatttcacaaatgttctatattaaaaatgcacacatacctaattttttattaactcattccacacaaacctttggagcatatgctttttgccagctgccattctaggccctggtgatacagaggtgaacaatagcaataaagtcctgcccccactggagcagacattaaacaagggagtgaataacgataattgtgcaccattatttaagatagtgataagttctataaaatgttaagtaagttaaagggacagacagtgagagtaaggggcaggcaagctttatttttgtcaaggtgatgagggaaggcctctttgaagagttgacattagagcaggctcttcaaagaagggagggagtaaaggatctggaagtctgaagaagagtattcttggcagaagatagcaagtgcaaaaccaagctcagtgtcttagaggagcagcaaggccagtgtgtctggaacactgtgagggaagacaaaggtggtagttggttaacaaggaaagaggtcagggaccaggtgatgtaggccttgaaggatggggcgagccttttgaattttattctaagtgagatggaagccactactaggtttcaagtcacttagtgacgatttatatatttaaaagctcattatggttgagaatgatgagaggtagtaaagcatgtgagttcaagcagggctgttgtgtcacaccacttatatttacattccaggtgcttacttccaagctgtgaggtcttgggcaggttacctagccttttcacatttcaagattcttatttctgagatgaagataacagtagtcttttatagggcggttgataggattgaatgagataatgcagggaaagcattgaacagggcaggtacaagtaagcactatattttcacttataattataattattatgattcttattatgaacattttcatcaaaactactttctttaacagctaggggaaggttgaaatactgtgaatattatcatacagcccagtgagattataaatactttgttattttctatcttccaaa

SEQ ID NO: 128428 - DNA, 7625 bp, Homo sapiens
  Payload ID: 5138
  Gene Symbol: DNM3
  Gene Name: dynamin 3
  Uniprot ID: Q9UQ16
  ENST ID: ENST00000627582
  CDS Start-End: 158-2749
agccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcagggactttctccctcgagggtcgggcattgtaacaagacgacctcttgtgctgcagcttgttacttctaaagcagaatatgccgagtttctacattgcaaaggaaagaaatttacagattttgatgaagttcgccttgagattgaagcagaaacagatcgcgtgactggaatgaataaaggcatttcctccatacccattaatttacgagtctattccccacacgtgttaaatctaacccttattgatctacctggaataactaaagtgcctgtgggagatcagccaccagatatcgagtatcagatcagagaaatgattatgcagttcatcacgagggagaactgtctgattttagctgttactccagccaacactgatcttgcaaactcagatgcgctgaagctagctaaagaagttgatcctcaaggtctgagaaccattggagttatcaccaaactggaccttatggatgaaggaacggatgccagggatgttctagagaacaaactgttgcctcttcgcaggggttacgtgggggtggtaaacagaagccagaaggacatagatgggaagaaggacataaaggcagccatgctggcagagaggaagtttttcctttcccacccggcttacagacatatcgctgaccgaatgggaaccccacacctgcagaaggtccttaatcagcaacttaccaaccacattcgggataccctaccaaacttcaggaacaaactacagggacagttgctctccatagaacatgaagtagaagcctacaaaaatttcaaaccagaagacccaacaaggaagaccaaagcattgctgcagatggttcagcaatttgctgtggactttgagaagagaattgaagggtcaggggatcaagtagataccctggaactctcaggtggtgctaaaatcaatcgtatttttcatgaacgctttccttttgagatagtaaagatggagttcaatgagaaagaattgcgaagagaaataagctatgcaatcaaaaacatacatggtatcaggacagggttgtttactccagacatggcatttgaagcgatagtcaagaaacagattgtaaagttgaaagggccttccttgaagagtgtggatctggtaatacaagaattaatcaacactgtgaagaagtgtaccaaaaaactggcaaacttccccagactctgcgaggaaacggaaaggattgttgctaaccacattcgtgagcgagaagggaagacaaaggaccaggtattgctattgattgacattcaagtctcttacatcaacaccaaccatgaagacttcattggcttcgcaaatgctcagcagaggagcagtcaggttcacaagaaaaccacagttggaaatcaggtgattcgcaaggggtggctcaccatcagcaacattggcatcatgaaaggcggctcgaagggatactggttcgtccttactgcggaaagcttgtcctggtataaagatgatgaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagggaacaacaaagctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacagccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaagccggagaccacccccatcaccaactcgtcccactataatccgcccactagaatcctccctgttagactaaacgaagtgtctggcatggcaattaatcactaatgaattatgcgaaagcaacatatttgataaccgttgcagtaaatcatgagtagtcgcatgtgtggacatcagtaggcaagtaaccagttttactaatgcattcatcgctcatcttcattgctcatggtatgtcaaacctttggggtttgactcagaaactgctaaccttttagaggctttatatgttgtactgaccaaggtaggtttgtatagcagccctatactttggggatcatttgcctaccatggcatatatttgaaattgctttggacaagttttctaggctatctaccaggtagctcattaaacgtaattcttcagatatgagatagtgggcttagacctaagccatacatatttcttttcccacattctgtttaggatgacagtaattctgttgtctaccattaatgctactacctactccataattgcctatttagctcctcttttcttcctttttatttcataagactgctaggaagtgattttttaaaattaggactccttaagaataaacttttccagaagcacgaggtagtttgcaaaggaaaagtctgcactgtttgctctaaagagcttctcctcattccaatgtgttttgcttcatgctagaagcatatgcaacagtgaataaaagcttctttttttgttaatcagtcaataaatttggctaattagtttcagagttcaaggaagaagcaaaatatcacatctctagaagtgttgggaaaaatataatttctttctttacttatattcacctcatggtaggttatattgaaggctgacatggagaatgtttacttttctatttggcatagctaactacactttgatactaactccagttttactattattattttggttggaaaaaaaattcactctttacgtgctaatttgtaatcttgttttgtaagaatttatcctacccttgaaacaggctcagtgtaactgtatatccattctaggctttcttaataaatcttgaggctatgggataatcacatttaaagaatggttcctgaaatgaagtcagtagaaatggcatgggataagagcagagctcacacttttacagttgcagtatttcaaagtccctatccaggtcactccagaaaagggtattgaaacgttgaaatctaaagcaaatttgcaatttcttaagatttctaaaatttaccagaacagtttagcctgggggttaatagttaagtcttgaggctaagttttggactaccaaggaccagatgattcacatgtaggaaacagccagaagccaactggaattttgtgtgctaactgttcccagacagcagagcaagtattcactgagtaggggtgtcccatgacactatttcatattctacagaagtaaatcaggtttcaccaactgaaatgtctccctttgaaagtagcaaacatgatttgtatgttaacttaactttaatttcctgtgtagtttacacccagagcagatactcataaagtataaagtaaaaacttttaaccattattaaacagagaacttgccatgttgagtgccattgtattgaacttattctaaaggcttatgctaacccatttataattggtaaaaatcagaaaatacaagatttacataaaggtcatttcaacttttaaggttaccagtgattgtataaaaacatcacaatcctaaatcctctcgtatctcaccccaaaccccaaactgggggaaaaaaagttaactctttgtgaatggaaccaatgtgcaagatacatactgcatttttaaaatagtgtctcagctaaatggaaaactgttaagcaaacatccatagtaaaacaaataatcttcagtgagatctttttataaaacttcttgtttttaggattccctttgcttcttcctttgaattctctaaaataggcagctaacggattatatacttcagggtttggctttgtgctaaatgtggttttgtgttttgctgtatttcaaaattttccttctgttaaaggaaaatattgtgaataaccactggtgtgttcttagatcagcacaaaccatgtcaaaaaaaattggagatttttttccaattttccttccactgatcttaggcagtaataaacaatggcatttgtcatctttggcacttgcttttagattatagtcccacagttgcactgccccaattgtctacctttgtgggtacatttttgttctttactcctaagttatttctcatagaacccagcctactctagaatttcagcagtgacattggagaatatttttaatttgctgcagtactatgtcatattattagtatgaatctcatttcccaaagggtttgtattctgctaaaaggagatgccaatgttgaatgaagtctgaaactctagtatgtgcatagtttgacgtgcagcatgcacaccaggccttaagatgggaatgtagcttaatgattttctgtttcccataccatttctaatcttttgtgtaattttctcttaactgattgctctgatattgtaaacacaatagatgtagctctatcatgtctagcataatttaaaaaatcagtgtttttaggatttgggaaaataaactgtaaatgtttatttgataggtaaatatagttttattgtcacatgctaaatattgcatgcatattgactaattggaataaccatttactcaattatggacagcttattgaaatagtattgatttagaaaaagtatattgcatttctaaaaaacatctaccaaggttactcgtctgaatattgcttttagccgtgttttataacatagacgagcagtagggtctgtttattagcaaatttcctatttgttccaatacaaactcactttattctaaagtatattaatgaaaccagttcctgtgatgtaactgtaagccttctcgacttagacttaaaaagtggtcacatagattaattttgtgactttttagtatagactgtagccataattctcaaatatgaaatgggacctaataccagtatgtgataaatgttgatgttttctgtgtacaaacacattttctatgcatgtgtctctgtgtatatggcatatacctagtaagtatgtttctgtaagtatgtgtattttatgtccatttgagtaggtaggtaggttttaaaaatactagttaaaatgccacaagcatgagtgtgattgtatgtgcactgtgtgtatatatataaatatatgtatatgtatggttgtaaatatctatgtatacatgtacttagtatgtgtggtatcaggatattttttaaactgtgataatacaacagatagctttgaatgatctgccataacatgtggtaacaatagttcatttctcataacatatatgaggtatacaaaattttctaactccagattgtagtcattttgagaggtacaaagctcataattaccatgacaacatggtaatgtccatagacatttgtatctgaatccacaagaagatctgaatctaagaaggaattacctttgacaatatttttcggtaagaagtaaaacctctggagacctatctttaagatctctaattggaattataaattatttttggattgctgagctgaatcttaaaaagccaagttgatatacatagtcatttttcctctatggtagaagtaaaaaaaaaaaaaaaggacatagcaacattaaagtagtggatttttctgagtaaatttgctgaaaatataagagagaagctatctaataccttggaggtaggtcatccactttttcaggtaaacatttttcatttggcaaatggcataattatttgaaagtgacaggaatctcctcagaatgaagaataaagcctactaggtctctaactgttgaactcatgaaagaagatagtgtatgagacttaagccatgagttttgtatcatttcaattagaagactactagctgtgagctcagagtttaatgtaaatgaatctagatgattttgaagaaatgattattcgttcaccagatcactcattgtacattctaaaaagctcaaatgagtcttctagatactcttactcatcctgtctggttgctatgtttaaaattatgtggtgctgtgtaggtgaaactttaagaatatttttgaagcatatgtaatatatgcactgctatttgtgtgtgtgtgtgtgtctttgtatatatgtaagaatgtgtgtatgtgtgagagcaagagagaggaaactcaaagaggagtgtttgtcttaagacctgttcatactggtatattggtgagacttctcacttctggttggaggtttcacatatggctcaactcaagtcattaatctctttttaatttttactcttgaattccttaaacttcgctcattatgaaatgttttaaaattatgacaaaaattactctgtctaaccacttgccttgtctgctaccagtttgttaaaaattattccccccaaccagtaattccaccagtactacttgatttgtgttatatttcctatgtacatgtacagcctttgttttgcttgcttgtctatttttactttcccttttttgggtcaaatttttcttttgctttgtttgaagaaggaatatacagaagtaaaatcttgtcttctctgctgattctttaattaatatgagccggatactttccactgtcttcttggcactttcaggatttcttaatgctgatatatggactcttagaatggaatttttgaagaaaaatctcaaagcctgtatcgttcttgaaggtcacatgtacctattgtgaaaatgtgaagctgtatttctgaagctgaaataaattataacatttgaagga

SEQ ID NO: 128429 - DNA, 6400 bp, Homo sapiens
  Payload ID: 5139
  Gene Symbol: DNMBP
  Gene Name: dynamin binding protein
  Uniprot ID: Q6XZF7
  ENST ID: ENST00000324109
  CDS Start-End: 93-4826
aggggcggaggtgacagcgggctggggactggcggctgcaactgcctgccgcgccgagggaccgccgggcggcggaaagcaggttataaaacatggaggctggctcagtggttcgagccatttttgacttctgccctagcgtatcagaagaactgccgctctttgtgggagatattattgaggtgctggcagtggtggatgaattttggcttctaggaaagaaggaggatgttacaggacaattccccagcagttttgtggaaattgtgaccattcccagtctaaaagagggagagaggctgtttgtgtgcatttgtgaattcacatcccaagagttggataatcttcccctccatcgaggtgacctggtgattctcgatggcattcccactgcaggctggctgcagggccgaagctgctggggcgcacggggcttcttcccatcttcatgtgtccgcgagctctgcctctcctcacagagccggcagtggcactcccagagcgccctgtttcagattccggaatattccatgggacaagcccgggccctaatggggctttctgctcagctggatgaagagctggacttcagggaaggggatgtgatcaccattattggagttcctgaaccaggctggtttgaaggggagttagagggccgaagaggcatttttccagaaggttttgtagagctgttggggcccctgaggactgtggatgagtcagtaagttctggaaatcaagatgactgcattgttaatggtgaagtagatacccctgtaggagaagaagagatagggccggatgaggatgaggaggagccagggacctatggggtcgccctgtacagattccaagccctggagccaaatgagctggatttcgaggtcggggataaaatccgaattctggcgaccttggaagatggctggctggaaggatccctgaagggcaggacaggcatctttccttaccggtttgtgaaattatgtcctgacacacgggtggaggaaaccatggctctgccccaggaaggcagccttgccaggatcccggaaacttctttggattgtttggagaacaccttaggagtagaggaacaaagacatgaaaccagtgaccatgaggccgaggagcctgactgcattatttctgaagcacccacttctcccctcggtcatctgacttcagagtatgacacagacagaaactcttatcaggacgaggacaccgcaggagggcccccgagaagcccaggcgtggagtgggaaatgcctcttgccacagactctcccacatctgaccctacagaagtagtcaatggtatttcctcccaacctcaggtcccttttcatcccaacttgcagaaaagccagtattattctacagtgggagggagccacccgcactcagaacagtaccccgaccttcttcccctagaagcaaggactagagactatgccagcctacctcccaaaagaatgtattcccagctaaaaactcttcagaagccagtgctccctctttacaggggctcttctgtttcagcttcaagggtagtcaaacccagacaatcaagtcctcagctccacaacctagcaagttatactaaaaagcaccacacgtccagtgtttactccatctcagagagattggagatgaagcctggtccgcaagcccaagggcttgttatggaagcagcaacacattcacagggagacggcagcactgacctggactcgaagctgacacaacagctgatcgagtttgagaagagcttggcagggcccggcacagagccagataaaattttacgccacttttcaatcatggactttaactctgagaaggatattgtccgaggttcctcaaagttaatcaccgagcaggagctgccggaaaggagaaaggccctaaggccaccgccacctcgtccctgtactccggtatccacttctccccatttgctggttgaccagaacctaaaacctgcaccacccttggtggtgcgaccctctcgcccagctcccctgcctccctcagcacagcagagaacgaatgcggtatcccccaagctcctatctcgacaccgtcctacctgtgagaccttagaaaaggagggccctggtcatatgggaaggagtctggaccagacctccccatgccccttagtgctggtgaggattgaggaaatggagcgggacttggatatgtacagtagagctcaagaagagctaaacctcatgctggaggagaagcaggatgaatcatcaagagcagagaccctcgaggatctcaagttctgtgaaagtaacattgaaagtttgaatatggaactccagcaactaagagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagagcctatacaacgaatggggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctggtcctcaagtaccgtaagggtgatgaagatagccttatggagaaaatttccaaactgaacatccactccatcatcaagaaatccaaccgagttagcagtcacctgaagcatctcactggctttgctcctcagataaaagatgaagtatttgaagaaacagaaaaaaacttccgaatgcaagaaagattgattaagtcttttatccgagacctgtctctctacctccagcacatccgggagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcgttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctgccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaatggttgtgctgtacggcgtttggggtggccccatgttccatgctcagctgaccggatgccaactcagatgaaaagaattcatggctctgggcaccccgtgaggcagtgcttgcacatggctgggagtttgtcgggattgaaccaaacctagtgcttcaaagctcctgggacacctccagtgtccagcacacattctcatacatactgcccctaatttctaaagtccctaaagcactacattctgtaaccttgtttcttttactccattcccagattagttatgcaaaattcaactgcgttctacttttagaagtgtttagggtctttattttctgttgacccttcatctgaaagattctcttcccttgttaggtacaatcactgcccccccgcttttttttttgagatggggtcttgctatgttgcccaggctggtcttaaacgcctgggctcaagcaaccctcccgcctccctgctgagattacaggtgtaagccaccataccgcaacctcaatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccctaatgactgtttagttacatccatagatgcagacaacataacacctgtgacttacttgaattgggataagccattccagaagtagcttatcctagacttggaaataagatttttttcaccactaacttccatgcttcagagatgacattcaaagccagattcccaagtgcctgatcatacctcccagtctcaggaagatatttgcttaccccttagaccaagaatcttaagatcttccccagctatgaagcctatcttggaatgggaaaccatgaaatttgtcttttaaaagaaagggaagaaatagccttacagcccctgttcctccaagtgcacatttagccttaaaatcctgggagtcgggagacaccgtggagtcctaacatccacagtgtctgctggtcgtggtcagaaggcagtaatgcaagagtccttttgtgaagagtgtttctatgtagagatgtttatatttaagtagttcttttataaataaaagcatttctaatggc

SEQ ID NO: 128430 - DNA, 679 bp, Homo sapiens
  Payload ID: 5139
  Gene Symbol: DNMBP
  Gene Name: dynamin binding protein
  ENST ID: ENST00000422692
  CDS Start-End: 7-679
ggggaaatgccgaccctattcaaaggagtttggggggttgtggagcattccagagctctgggaagattctgtcccgcctgcttaccctcaggcccacacctccacacacagccagctctgggcactgcagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagagcctatacaacgaatggggatgcacaaattatattaacctgggctccttcctcatcaaaccagtacagagagtaatgcgttacccgctgttgctaatggagttgc

SEQ ID NO: 128431 - DNA, 4177 bp, Homo sapiens
  Payload ID: 5139
  Gene Symbol: DNMBP
  Gene Name: dynamin binding protein
  Uniprot ID: Q6XZF7
  ENST ID: ENST00000543621
  CDS Start-End: 132-2603
gggaaatgccgaccctattcaaaggagtttggggggttgtggagcattccagagctctgggaagattctgtcccgcctgcttaccctcaggcccacacctccacacacagccagctctgggcactgcagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagagcctatacaacgaatggggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctggtcctcaagtaccgtaagggtgatgaagatagccttatggagaaaatttccaaactgaacatccactccatcatcaagaaatccaaccgagttagcagtcacctgaagcatctcactggctttgctcctcagataaaagatgaagtatttgaagaaacagaaaaaaacttccgaatgcaagaaagattgattaagtcttttatccgagacctgtctctctacctccagcacatccgggagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcgttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctgccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaatggttgtgctgtacggcgtttggggtggccccatgttccatgctcagctgaccggatgccaactcagatgaaaagaattcatggctctgggcaccccgtgaggcagtgcttgcacatggctgggagtttgtcgggattgaaccaaacctagtgcttcaaagctcctgggacacctccagtgtccagcacacattctcatacatactgcccctaatttctaaagtccctaaagcactacattctgtaaccttgtttcttttactccattcccagattagttatgcaaaattcaactgcgttctacttttagaagtgtttagggtctttattttctgttgacccttcatctgaaagattctcttcccttgttaggtacaatcactgcccccccgcttttttttttgagatggggtcttgctatgttgcccaggctggtcttaaacgcctgggctcaagcaaccctcccgcctccctgctgagattacaggtgtaagccaccataccgcaacctcaatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccctaatgactgtttagttacatccatagatgcagacaacataacacctgtgacttacttgaattgggataagccattccagaagtagcttatcctagacttggaaataagatttttttcaccactaacttccatgcttcagagatgacattcaaagccagattcccaagtgcctgatcatacctcccagtctcaggaagatatttgcttaccccttagaccaagaatcttaagatcttccccagctatgaagcctatcttggaatgggaaaccatgaaatttgtcttttaaaagaaagggaagaaatagccttacagcccctgttcctccaagtgcacatttagccttaaaatcctgggagtcgggagacaccgtggagtcctaacatccacagtgtctgctggtcgtggtcagaaggcagtaatgcaagagtccttttgtgaagagtgtttctatgtagagatgtttatatttaagtagttcttttataaataaaagcatttctaatggc

SEQ ID NO: 128432 - DNA, 1704 bp, Homo sapiens
  Payload ID: 5140
  Gene Symbol: DAW1
  Gene Name: dynein assembly factor with WDR repeat domains 1
  Uniprot ID: Q8N136
  ENST ID: ENST00000309931
  CDS Start-End: 84-1331
gcgcatgcgcacccgcgtcccgctgctgtttagccgtttccaaggctacgaagcccatcggccggggataagagagcaagaaaatgaagctcaagagcctcctgctccggtattacccgccaggaattatgttggaatatgaaaaacatggagaattaaagactaagtccatagatttgcttgatcttggtcccagcactgatgtcagtgcgttagtagaagaaatccagaaggcagaacctctactcacagcttcacgaacagagcaagtcaaacttttgatacagaggttgcaagagaaactcggccagaacagcaatcacacgttctatctttttaaggttctcaaagcacatatattgccactgactaatgttgcacttaacaaatcgggctcatgctttatcacaggaagctatgatcggacgtgcaagctctgggacactgcgtctggagaggagctgaacacgctggagggccacaggaatgtggtttatgccatagcattcaacaatccttacggtgacaaaatcgccactgggtcctttgataaaacttgtaaactctggagtgtggaaacaggaaaatgttaccataccttcaggggtcatacagcagaaatagtgtgtttatcatttaaccctcaaagcacattggtggcgactggaagtatggacacaacagccaaattgtgggacattcagaatggcgaggaagtttacaccttaagaggacattctgccgaaatcatctccttgtcatttaacacctcaggagacagaatcatcacggggtcttttgatcataccgttgtagtgtgggacgctgatactggaaggaaggtaaatatcttaattggtcattgtgctgagattagcagtgcctcattcaattgggattgctctctaatattaactggctctatggacaaaacctgcaagctgtgggatgctacaaatggaaaatgtgtggcaaccttaacaggccatgatgatgaaatactagacagctgctttgattacactggaaagcttattgcaactgcttcagctgatggaacagcaagaattttcagtgctgccacaagaaaatgcattgccaaactggaaggtcatgaaggtgaaatttcaaagatttctttcaaccctcaagggaaccatcttctaactggcagctctgacaaaacggctagaatctgggatgctcagactggccagtgcctccaggttcttgaggggcacactgatgaaatcttttcatgtgctttcaactataaaggcaacatagtcattacaggcagcaaggataatacctgtaggatatggcgttgactgaaggaagctggtcagtgagcaaccttgctagcaatggtaatcaagaactggaacttcacagacagcagctctcttaatatttcttatactttctctttttctgcaagtcaactatttctacaactgtccttcatttcacagatatgaccattaaacatgacaaagttatgccactccaatattattatttgatggcgatggcaggacacagcataatgtttggctaatgccaccagttatttcagttgtgtttgttttttaaaagcattatgatactgaaaaaggagaccagaacaacttaacaacgtgtctcctggattttactttgaagcctattgttataatttctgttgaataaagtgtttggagg

SEQ ID NO: 128433 - DNA, 2476 bp, Homo sapiens
  Payload ID: 5140
  Gene Symbol: DAW1
  Gene Name: dynein assembly factor with WDR repeat domains 1
  ENST ID: ENST00000373666
  CDS Start-End: 637-1746
aggctttctggtgtaggttccgacgcacctgccttccattcccgcctatccatttaggctgcgacctctggtagttctccactttctctaattctgagttacttcatccttaagaagtggtgcataactcacaccttgttaggattgtatgagtatgtgtgcatacaccgtttaaagcaatgtagggcacagagtcaggaaatgcaaaatattaagttgaggtcatttttcttttgggaggacaaggacagggcacgggctggggccctagagtagtaattagcgatgggcttttcctcccagccttccttttgggaaacgcagtgtgctaaaaaagtgcatgcagcccaggctgtggcctaggccgtcggttcccggccatgcctagctcctctgaggtcgcccttagtgaggacacgaggtgccctcacctctttcactctagacacctccagaacactcgccccccgcgcgccggagccccgggtcgccaccaaccgcccgcggagccagacctcccagctctgcgccccaggaccgcgcggtgcaacctgcgcatgcgcacccgcgtcccgctgctgtttagccgtttccaaggctacgaagcccatcggccggggataagagagcaagaaaatgaagctcaagagcctcctgctccggtattacccgccaggaattatgttggaatatgaaaaacatggagaattaaagactaagtccatagatttgcttgatcttggtcccagcactgatgtcagtgcgttagtagaagaaatccagaaggcagaacctctactcacagcttcacgaacagagcaagtcaaacttttgatacagaggttgcaagagaaactcggccagaacagcaatcacacgttctatctttttaaggttctcaaagcacatatattgccactgactaatgttgcacttaacaaatcgggctcatgctttatcacaggaagctatgatcggacgtgcaagctctgggacactgcgtctggagaggagctgaacacgctggagggccacaggaatgtggtttatgccatagcattcaacaatccttacggtgacaaaatcgccactgggtcctttgataaaacttgtaaactctggagtgtggaaacaggaaaatgttaccataccttcaggggtcatacagcagaaatagtgtgtttatcatttaaccctcaaagcacattggtggcgactggaagtatggacacaacagccaaattgtgggacattcagaatggcgaggaagtttacaccttaagaggacattctgccgaaatcatctccttgtcatttaacacctcaggagacagaatcatcacggggtcttttgatcataccgttgtagtgtgggacgctgatactggaaggaaggtaaatatcttaattggtcattgtgctgagattagcagtgcctcattcaattgggattgctctctaatattaactggctctatggacaaaacctgcaagctgtgggatgctacaaatggaaaatgtgtggcaaccttaacaggccatgatgatgaaatactagacagctgctttgattacactggaaagcttattgcaactgcttcagctgatgatggagtctcgctctgtcgcccaggctggagtgcagtggcacgatcttggctcactgcaacctgcgcctcccaggttcaagcgattctcctgcctcagccgcccgagttatgtcacgttcttggtaatcatgtttgatgttatccggtgtgttcatctctttgatcactggacgtgatgctaaactatgcctgtgtcatctgctgtcaacaatatggaacagcaagaattttcagtgctgccacaagaaaatgcattgccaaactggaaggtcatgaaggtgaaatttcaaagatttctttcaaccctcaagggaaccatcttctaactggcagctctgacaaaacggctagaatctgggatgctcagactggccagtgcctccaggttcttgaggggcacactgatgaaatcttttcatgtgctttcaactataaaggcaacatagtcattacaggcagcaaggataatacctgtaggatatggcgttgactgaaggaagctggtcagtgagcaaccttgctagcaatggtaatcaagaactggaacttcacagacagcagctctcttaatatttcttatactttctctttttctgcaagtcaactatttctacaactgtccttcatttcacagatatgaccattaaacatgacaaagttatgccactccaatattattatttgatggcgatggcaggacacagcataatgtttggctaatgccaccagttatttcagttgtgtttgttttttaaaagcattatgatactgaaaaaggagaccagaacaacttaacaacgtgtctcctggattttactttgaagcctattgttataatttctgttgaataaagtgtttggaggaaa

SEQ ID NO: 128434 - DNA, 564 bp, Homo sapiens
  Payload ID: 5140
  Gene Symbol: DAW1
  Gene Name: dynein assembly factor with WDR repeat domains 1
  ENST ID: ENST00000440997
  CDS Start-End: 352-564
tttagccgtttccaaggctacgaagcccatcggccggggataagagagcaagaaaatgaagctcaagagcctcctgctccggtattacccgccaggtgaggacatggtcacctttaaagaataagtgacacccattgatcacccagcttcttagggacagaaataggagtgcaattcttgggttctaattcagaactcgtcttctgaattagaaacatctgcaaaaaaaaaaaaaaaaagaaaaaaaagaaaaaaatctgcaaaacataccacaaggcagaagataaccaaatacacttgcccaatgaagtttggataggaagtgtcataaagatttcaaaggagggaattatgttggaatatgaaaaacatggagaattaaagactaagtccatagatttgcttgatcttggtcccagcactgatgtcagtgcgttagtagaagaaatccagaaggcagaacctctactcacagcttcacgaacagagcaagtcaaacttttgatacagaggttgcaagagaaactcggccagaacagcaatcacacgttctatctttttaag

SEQ ID NO: 128435 - DNA, 725 bp, Homo sapiens
  Payload ID: 5140
  Gene Symbol: DAW1
  Gene Name: dynein assembly factor with WDR repeat domains 1
  ENST ID: ENST00000454999
  CDS Start-End: 49-159
gtttccaaggctacgaagcccatcggccggggataagagagcaagaaaatgaagctcaagagcctcctgctccggtattacccgccagtctttggtgagccaaatcatatgcaagtttccaagatactactgaatagcaggaattatgttggaatatgaaaaacatggagaattaaagactaagtccatagatttgcttgatcttggtcccagcactgatgtcagtgcgttagtagaagaaatccagaaggcagaacctctactcacagcttcacgaacagagcaagtcaaacttttgatacagaggttgcaagagaaactcggccagaacagcaatcacacgttctatctttttaaggttctcaaagcacatatattgccactgactaatgttgcacttaacaaatcgggctcatgctttatcacaggaagctatgatcggacgtgcaagctctgggacactgcgtctggagaggagctgaacacgctggagggccacaggaatgtggtttatgccatagcattcaacaatccttacggtgacaaaatcgccactgggtcctttgataaaacttgtaaactctggagtgtggaaacaggaaaatgttaccataccttcaggggtcatacagcagaaatagtgtgtttatcatttaaccctcaaagcacattggtggcgactggaagtatggacacaacagccaaattgtgggacattcagaatg

SEQ ID NO: 128436 - DNA, 14862 bp, Homo sapiens
  Payload ID: 5141
  Gene Symbol: DNHD1
  Gene Name: dynein heavy chain domain 1
  Uniprot ID: Q96M86
  ENST ID: ENST00000254579
  CDS Start-End: 565-14826
aacggttctaacagctgggtgcgggtggagctgcgggcgatcgccagctcgagtgcagattccttgctgtgaccgaggttcagagtgagctctgtcggtgtgtcagtttgcctcttcaggcactcttcaatgaaacctcatcagcagatcgggctctcttcccttgccttgcctcctaacccccctaggccaggtgagggggacagggtactgggaggtaagaaggaactcttctgcaaggagggctctcacgtctgtcttaggcctgctccttaccagagtctttggggaagcagtagggagggcctgagggtctcaggaaaggctctctgctggtctggctctgctctgtagctccatctatttccctgtcccaggtcctttcttcctcctaaccccattgactctgaccatcccctgcccagagcctgaggtcccttctctggcccctctgctgggctggcccatgcaggtgaggccccgcatctggcatcctggaactggcagttggagcctgagctatgggcaaggtcacttcgacagcagttgaatgcccagctcctcatggtcccggaggagaggagggtaggtttgtcttctgatgagacatcatctgattcccttaagtcttggcactccatatgtgtcttggacagcaaagaacagcccttggcctgccagcagaaacagaggcagttcgtgaagccagtgactgagtcagagcagcccacagtgctggaactcctgctagctgagctccgaactctgttctcagctgtgttgcaggacagtagccctgcagcttggcgctatcttcatgcagtactgggtctactgcctccatatcgtgagttgctagttggccaccttgatttgctgcccttcctggagcagctgtactgctgggcaccctgggtccaaacccacctccatctggacctgctaggtgccattgtccaggcctttcctccagacagctctttgttagacagtgcttcccatgctgactgctgtccccagaagcggaggctccatcacaggcccccatgcccagcttgcccttttgtgcaggcccagtggagcaggcagcaagtaaaggaggagctggccacctggctgcgaccattgacactgcctgagctacagcgctgcctgggcattgttggtgctcaggtggccctagaagaggctgtgtggctggatggacttagtctccttcccttggcactggcagcggacatccctgtacggtatgaaagcagtgacactgacaatgcagaggtggagcctgttggaagaaaagagaccaggtctcagcttgactatgaagttcccagggaaaaggccttccaaaagagcagcaccggcttttcacctgagacttccttcctggatagccaggtgatgactgctctgaagatggagagatacctgaagaagatccacttcctctatctcaatgtggctcccagccggtactttaggccttacagcctgatggtggtgccacccgacaaggtgaatcccgagcactacatcttctctccctttgggatcttgcatgtacatcctgtggaaggtagcgagacgatgacactgggtacctggcaccatcactgtgttctctggcagcagctccagttcattccattctttaagtattgcctcttacgcaagtcctttacctgttggaagaagaatgtgagattacaggggctgcatcgactccagaaattcctagagaatcatctgctcttggctgtgccccactttggagctgggctactccatattagcaggcttctgcaggagctacactctgtgtcctggctaccccaggaactggatcggtgctatgagctgctggacctgcagacggctctagccgaggagaagcataaggctctacggctgctccatcgttgcctaaacctctgcacatccattcttcgactggttcacgaggacacataccacatgcaacagtgcctacaggagcgagtacaaaactgtgacaggatcaggacaggccaaggctccatataccttcagagggtacagcacaagcaactggagcagaagctgaagcaagcagaggcctggtggctgcagctgggaaagtttgcccgcctggttgactacatgatttgtcagagcctcatttctgtcttggaagagcagataacctcttttgtggccaacatccttcaagccccaaggcagaaaccctttctctcatcacagctggtctttgatgatcatggtcaactgtctcatgtgccctgtgttgaaaatatgatccagactctaactggaggcctacagtctgtcaagacctctgccttgcaggtagtgcagtctgcagacctgaagacctcctcggattccctgtattctgaagaagaagatgaagaggaggactcaaaagacgaatttctgatgcccaagttccagggccagcccagcgatgctgtgagcatcttctgtggcccgaatgtgggattggtgtggccctggaagtctcacccaattgctggtatcttggaggtccgtggatgtcggctgcggggccaatacttcccccacaattataagcagctggaggaagacctggacaacaaccctaagatccagcaggcactgaatatacaacaggtgctgctggagggcgtgctgtgcaaggtgcaggaattctgcagggaacatcattggataacaggcatttatgaattcctgcaatcctgggggcctcagaagctggaagacatgagaggtggtcccatcaagaactacgtgacgctggtgagccgcctgaatgtttggcaggcccgtgtctccagtatgcctatcgagttgctcacaaaaggcgggttgctgctacttagctgccatgatgtacaggcagagatggaatccaagctgaacagcataaggaaggacattcttgcacacgtgcaaaatgagtgctggaacctcagtcaacaactcatgacagagctcacagatttcatgcatatcttccgaaccatcaactcagatattcatgccattgcacagtgcacccagaagttgaatgaagccaatgaacagtacgtcgagctggaggagcgaatggaatacgtacgggcactccacgaactcatccgcaaccactttagcctctttagtgctgagaatgaagcactggacatctcggtgagaaggcaattcggggagtcacccatccctccctgccctcctcccccacaaccacatctactccactgccctctgcttgccccacagcttctggatatgtgggaggcatttcagtttgagaaaagccaggcttcagagttcctgctcagcaagcgacatgccattatgcccaagctgcagcagctgatggcagcagcattggcagagctggaaggcctgcttgcgaaggccctctccggtccctttatggaccccacacaagatcagaggagtactgagcaccagctcgtctccctagagcgtcagttccagaacacagtcagcgacctcagtgaactgcaccacgcctatgccatcttcactgaggatgagactcctgtgcccttgccaatctgtgggacacgtcctattgtgcagcagcagcgcatatggcacctgtaccgagtcatctccgaaaacatcagcgagtggaagtgcatggcttttgccaagttcagcccagctatggcccaggagaagacagagggctggctgacagaggcagcacggatgagcacaaccctggagctgcacagccccgtgctgcagcactgcatgcgcatcctgggggagtttcgcagctacctgcccctgctcactaagctgggcagcctccacccacagagcctcaactgccagtgtctcctgcgtgcccttgggctgggcagtctccaaactatagaactcctaacgctgggccagctgcttacttatccactgctggagtttgcagatcgaatcaaccaggtctggcagaatgaaaatgaacgaattcatgcccaagagactatacggcggttgcagcggtactgggaagcgcgccagctgcgcctgctcaacttcatcctgcatgtaccctacgagcccccagcctcagagcgctccaagaggcaggtgctccgcagcccccaatgggaggtagtggacaaagatagtggcaccttcatcctctcagattacagcaacctgcaggattccatccaggaaagtcttcaggtgttgtccaagatcttggccatcgaaaagtcaggagatttaaacaaaatagctttggagtgggtggccatcatgcatggcctgggtgccctgctggaggtgtggctgactttccagcagaagtggatttttctgaataaagttctgcatgagatgaagatccagtttcctaatgctgacctgaactctcgtttcaaggtcatggatgaccagtatcgaaccctgatgcgcatctctgtagctgaccccatggttctgtcacttgtagtgcccagtgccgagaggagcccttacttccaaggccagcagctgcaacaactgctgcaagcaggatcggtggagctggagggcatcatcatgagtctggagagcgtgctctatggggtgtgtgctcacttcccccgcctcttcttccttagtgacagtgagctggtagccctgctggctgctcgactggaatcatgcgaagcccagctatgggtacgacgctgctttcctcatgtgcatgctgtgagcttcaggtcttgcccaactggtgagaaaaacacagatgactgggagtcaagcccaaacacacagactcaggtggaggcacttgcagtgctaggggcaggtggggaggaggtgaagctgcagggtccccttcctctgcatccagatctccctaagtggctggcctctctggagaagtgtctgcgcttggcactggtgcacatgctgcagggctgtgtggctgctcgccttgctcgaggcccatctctaggtgaggccctcaagcaactgcccaagcaaaacaagttgtacctgcaactgtatgtccagcactggatcgacttagtccaggccttcccatggcagtgtgtgctggtggcagaggaggtggtatggcgggccgagatggaggaggctctgcttgagtggggtaccctggccatggtctccatgcatatgcgcaagcttgaggtactggtgaattttatgcgggcccagagggcttcccaaggtgggcagtccctgccttctgtccgccagaccagccttctcagtgccctgctggtcatggcagtgactcaccgggatatagcacagctgctggaacagcaccaggtcagtgatctcacagactttcactgggtccgccaactcaagtatcacttgggttcacctcacataatccccaaaagccccctacagagtcttaagactattgcatcttctgaaccctctctgtcaccagcggcatgctggatagatgtgctaggcaggtccttcctgtacaattacgagtatctgggacctagactagggcctctacccagcctactgcctgaacggccagccctggtactattattggccctagaggaggtggcctgtgggaccgtactgggtcctaatggtgtgggcaagagagctatagtgaacagcctggcacaggccctgggccgccagctggtgatgctaccctgctcacctcagatagaggctcaatgcctgagcaactatctgaatggtgccctgcagggtggtgcctggctgctgttggagaaagttcatcagctgccccctggcttgctctctgccctgggccagcgcctgggtgaactgcaccacttgtatgccccactgtaccaggaggcttcccgaaacacaagcaccatagaccccacccagccccagctccttggcagtagcttctttgaaaaacatcacgtgtctgtgcgccttggctatggctgtctcctggtactgcgtgccctgagctctgctgtgcctgccaacctgcacctgctgctgcggcctgtggcattggcattgcctgatctgcggcaagtggcagagctgactctgctgggtgcagggatgagggatgccttccagatggctacccgcctatccaaattcttctctctagagcgtgagctggtgtctgggcccctgccctgccgcctgccactgctcaagcagatactggaagacacaatacggacactaaatgtgaccaaggaggaaccgaagtgccagaagcctcgcagcctagctgccattgaggaggctgccctactgcgctcaccactgtttagcattctcaatgggctccacctgcacaacctccgagggctgttgtgtgcgcttttccctagcgccagccaagtgctggcagaacctatgacttacaagctgatgaagccattggtggtggaggaactgcaacaggtaggtctggatcccagccctgacattttggggtccttggaacagttgagccaggccctgagccgggcctcaggcattctgctcctgggccctgcgggcagcggcaagaccacttgttggcacagcttatttaagatccagaatcggctggcagccatggaggacacctcaacccaaggctgccagcctgtggaaattacccacctgtaccccagtggcctcagcccccaggagttcctgggatggctagagggctcctgctggcatcatggcatctttcccaaggtacttcgtgcagccggtcagtgtaacaacatgggccaaaagaggcagacagaggaatcaatcgggatccagcactggataatatgtgatggagcctccaatggtgcttggctggactccatcacttgcctcctgagtgagcttccccagcttagtctccccagtggacagcagatagcacgacccccaggcacctttctcttgatggaggtggctgacacaacaggcatatcccccacagtggtaggctgttgtgccctagtctggtgtggtggagagcagacttggcagtgtatacttagtgccctgatggcatcccttccttatgagtaccgcctgcagcaccggacagtcgctgagctcaaccacatggctgaggttctggtgcctgcaacattgcgattcctcacctgccaaggtgtcagctctctgctgcaggtacacgggcagcaggctgtttgtgcaggtgtggcagaagttaccagcatggcacgcatcttgcatagtctgcttgacctccaccttcgcctaaaggaggagaaggcccctggcccagaggacctcagctatagtgatcctgtggcccaaagcttcaggtcttcaaaaagcagctttctaaaccggtcccaggttgacagtgacgatgtgccagataagtgcagggaacacttgctggctgtcagcagttttctttttgccttgatctggggctttggagcccaccttccctccaggttctggcccatctttgataccttcataagggattctattagtcgcctctccaactaccctgagccaccaccctcagccttggtgtttgatctacatgtaagccctgaagatggaacactggtccccttcactggccaatacctgagcagccacatcaaaggaactttgggcacctttcacccttctatccagactgaacggctcttgtatgtggtggacctgcttctgtcagggggacagccagtgttgctggctggagaggcagcaacagggaagtcagcctttgtggaggtgctggtagagccacatcacccttacatatacagccccatccaccctgccttcagttcctcccacctccgtctcctgctgagcagaggaatccagggccaaacacaagccagcccacagcctgggcatcaccaggattctaaaccctccctcctcttcttgctggaggacctgcacctagccacttctgacccagagaagagctgccagccagtgttggagactctgcgccaggccatggatggcactgtgtatgcccacagcaccttggaactgcagacgctgcagcctacagtcaacttccttgccactgtcacagtgccaggatactgtgagcgcccactgtgtccacgcctctttcgactcttcacagtcctggccctggaaagcatgacccaggccaccctgctggaaagacatgtgcctatcattcaggcttggcttgagcgtttcccttctgtggaacgggagcgtgctctggcacgaggtctggttagggcctcagtagaggcctgggaggctgtgtgcaattgcttcatgccttcacccctccacccacactaccacttctccctacactctgtgagccacctactgagcagcctgcagctgctgcccaacagaacaggctcccgaggttttgtggactatcccaaccaccaggagcacttgcgccgggtgtcaggcctgcgaggcacttgtctgaccgttatgatggccacacgcaatgtggtgcgtctttggttgcatgaggcacagagaaccttttgcgaccggctggacagccccagggaacgctcctactgtgccaagctgctcctagtagtagctcaaagtgtcttctgctgtgggccagggccccagcacctgggcaaggaccatcaggagagtgaggaggaggaggaggaggagagggtgcccgaagtagaatctgaaggggagttggcccagtgggaggacttcagcaacagcaatagtgaaacagaggaggaagaggaaccttatggccttcaggtcgccagagtctcaaactccagagatccaagtctaacaccatccataggaccagtaagcagggggatgaaggaaagcataagtcacaagataaggcaagagaaaggcacaagggcatccaactataggctccaggtaaggagatcattcaagacttggtggcagaagaaaccccagatggacctgatctcacccttgttgttaccagtgttactactacatccccaggaaaagccctcagacctggtcttcagtcaggagctgatactggggcctaactctgagacccccaacttgtacctggaacgacagtgggagaagctagaggagcagttggccacctcagctgctcaactgaagttgagcccccacctggcccggtgtcattccatggcccagcacgtggcccgcctggtccgggtgctggccaggccccggcagcatggcctgctgctctcgggggctctgggtactgggcgccacactgccatcactctggcttctagcatttgtcaggcccatttctttcatctaccatctgggtcagaggaggccattctccaatgtctacgagatgccagctggcatgctggcatgttaagccagccagtggctctgttggtacccagtggtgtggatctcactacacttcatcgcctcctggccctggcaacctcaggcagtttccctggccagtacacagaagcagatttggaccgcattggagaacacctccccagggagaaccttggtgtcaaacagaacatcaagaaggaaatggtgttgcagaggttccaccagcaagtgtgcagccaccttcacctgttcttcctgattggagataaacaggcccacaagcagctgccctccacccttttcctgaggctccttcaactggccactgccagcattgaccgctatgaaccctgggaccaagctgccctggccaaggtggcccagcatcacctggagggtgctcagagtgtgccccttgatgacggctcctggaagtacccagacctccaggcctcaattcccagtgtggccaaagccatggctcttatccacctttcggccacccactaccatgagcacctgtgccctgcattgccactcgtcacccccaagaccttcctagacttcctggacactttcctgatgctgcagcaacagacaatcctgaagattaagaacaaggcccagcgggtccagaatgccttggagaatctgagaatgctgattaaggagcacggtacccatgccaatctgatctttgacttggaacagcagctgaaagactccggcaagagtctcagcatgtttcagcagcagctagagcaaagcaagctcctatacaagcagcagctggaagagtgtcggcatcaagagaacctcattgagaacctggccaggcaacgggatgccctgcaagctcagcgagaggctttcctggagcagatgagcaaggcatttctggagcctctgagccagctgcaggtggctgactttgaggagatacggagctatcgagcaccaccagaatctgtggtccgggtaactgatgcaatgtgtgacttgttccaccatgaaacaggctgggccagtgccaaacagctgttatgcactgaggatttttatcaggagctggtgttcttccccaaggagaagataacagactcagagctgataaagttacatctaattctgaaggctccaggtatggacgatgcagccctgcgggcagtgagccgacctgcagccagcctggcagcctggctctgggctgttctgcactatgggctggcgcattgccggggactgcccacggacctgctgctgcagcaagtggaggcaacactcactcgggagcaggcccgcctgggctactaccagtttcaggcccaggagaccctggagcataatttggccctggctaagatggtggaggatgcccaagcttcccacaactgcgtggcaaagaccctcagtcaagcacagtgtgggcagtatcacaaatggcccatgaaggctgcactgctcacgcctatgcgtgcctggactacacagctccagaagctgaagggacgctgcatgactgtgtttggagataccctcctatgttcagctgccatcatctacctgggtcccttcccaccattgcggcgccaagagctactggacgagtggttagctctgtgtaggggctttcaggaggctctgggcccagatgatgtggcacaggcactgaagcggaagcaaaaatctgtcagcataccaccaaagaaccccctgctggctacacactctcccttcagtattctgtccttgctgagctctgaatcggagcagtaccagtgggatggaaacctgaagccacaggcaaagtcggcccacctggcaggcttgcttctgcgaagccccacacactacagtagttgccgttggcctctgctgcttgaccccagcaacgaggccctcatctggttggacccgctgcctctggaagagaatcgatcttttgcgccagccctcactgagggtagagggaaaggcctcatgagaaatcaaaagagagagagtaaaacggacatgaaagaggaagatgatgagagtgaagagagtaatgaggctgaggaccagacaaaagagcagaaggcagaggaaagaaaaaatgagcaggagaaagagcaagaggaaaatgaagagaaagaggaggagaagacagagagccaggggtcaaagccagcctatgagactcagcttccatcccttccctaccttagtgttctttcaggtgctgacccagagctgggttctcagctccaggaggcagctgcttgtggcctgcctgtgttactgaccaatgtggagctgggtctagggtgcgaagaactgcaatggctgctgcaacgggagcagctgagtccaccccaggtgcagcctggcttctgtctgtatctcagcaccaccctctccctctgtgccatggaaaaagtgctaggttgtgaactgctaaaggggctgaatgtgttggatctgggcctgaacatggaaatactggaagaacagatgctgcatgaaatcttgtgcagagagtatcctgaactcgagacccgctggcaggacctaaagatcagagccctagatacctgcaaggctgtggaggctgctgaggagcggctgctgacgatgctgctgttccagaatccgaagcgtcagaagccagccaagtttctgcggaacatagtgagggcccaaggaaagctatgccagctgcgtgctcattgtgaagagttagaagggcagaaactacaggagatggtattgtgggcaccctatcgacctgtggtttggcatggaatggccatggtaaaggccctaagccaactgcagaacctgctgccacttttctgtatgagcccagagaactggctggcagtcactaagcaggctctggacagcatgaagccacgtgagattaatcacggggaggacctggccagccatctactgcaattgagagcacacctgacccgccagctgctgggcagcaccgtgactgcactgggccttacccaagtacccttggtgggtgcattgggcgctttggctctgctgcaagcaacagggaaagcatcagagctggaaagactggcactctggcctggactagcagcctctcccagcacagtccacagcaagccagtctcagatgtggctcgaccggcctggcttgggccaaaagcctggcatgaatgtgagatgttagagctgctgcccccatttgttggcctgtgtgcctccctggcaggccactccagtgcttggcaggcttacctgtcactgtcatccacagtgctgggtcctgcacctgggccagggcctgagccactcagcctcctccagaagctgatcctgtggcgcgttctgcgacctgagtgcctggcaggtgccctggcagacttcaccactagcctcctgggtcggcccctggatgaaaacacgtatgctcccaccatgccctttaaacatagtcaggctactcagcccatgctgatcttgttgccaccgcctggccacccctcagccactctgcatcctctgactgtcatccagaaactggctgccaagtatcagcaggggcagaagcaactgcaggtgatagccctgggctctgaagcctgggacccagtctcagttgtggtcagcactctatcccaggctatgtatgaggggcactggctggtgctggacaactgtcatctgatgccccattggccgaaagagctgctacagctcttgctggaactgttaggcagagccaaggtggttgcagacctggaatcagaacagcttttagaccaacctgaaagcaggaatgtaagcactgttcacagagattttcgtctttggcttattgtgcctgcagagtctagtgcttctttgccagctgtgctgactcagcactccatgcctgttttctggaaccagtccctggagctgggccatgttttgattgacagtgtggagctagcccagcaagtactctacatgcaaccccccacccaggcactacctctgctcctcctccatggcctcctgctacaccggcagctctatggaacaaggctgcaggcacacagggggcgctggagtcaagtgactctaacccaggttcttcagacccaagaccagctgtgggcaagtcttagcaatccccgtgctgccatgcaagagctggctgcttcagttttctacgggggtcctctgggggacactgaggacagggaggccctgattagcctcacacaagcctgcctgagccccagtagtgggagctgggtccagccacacacacctcagtctttgctggccacgctcatgcccctcccagagctaagggagctggatgcaatggcagagtgcaaggcccagatgcacctactgccctcaccacctgaaccccggctctgcggactgagtgagggcccccaagcctggctgttgcgacgccagagtcgcgctctcttgagtgcgctgcagcggagttcacccgtgtgggttcctgagtctcgaagaggcgcccagcttgcggaaaggcgactgcggcaacgcctagtgcaagtcaaccggaggctggagtcactgcaggatctgctgacccacgtgattcgccaagacgagtccgacgccccgtggtcagtgctggggccaaatgcacggcggcctctggagggcgtcttagagaccgaggctctagaactgagccagttggtgggcacgctacaacgcgaccttgattgcctgttgcagcagctgaagggcgcacccccgtgcccctcccgccgctgtgctgcggtggcccacgctctctggactggccgcctacccttgccttggcgacctcatgcgccggccggtccgcagccgccctggcactggctgcgacagttgtcgcgccgtgggcaactgttggttcgttacttgggcgtgggcgcggacgcgagcagtgatgtaccagagcgcgtcttccacctgtcagcctttcgccacccgcgccgcctgctgctggcattgcgtggggaagctgccctggaccagaatgtgcccagctcgaatttccctggtagccgaggctcggtctccagtcagctccagtataaacgtctggagatgaacagcaaccctctgcacttcagggtggagaatggtccaaatcccacggttccagagagagggctgctgctgatcgggctacaggtcctacatgcggagtgggacccaatagctggagccttgcaggacagtccttccagccaacccagccctctgcctcccgtcagcatcagcacacaggccccgggcaccagtgacctgccagccccagccgacctgactgtgtactcgtgtcctgtgtacatgggagggccccttggcaccgctaagctgcagagcaggaacatcgtgatgcatctgcctttacccaccaagctcacccccaacacctgtgtccaaaggagggtccatgtgtgcagcccacccctgtcttgagcccgtctaccaaaataaagttgtagtgattccatg

SEQ ID NO: 128437 - DNA, 3205 bp, Homo sapiens
  Payload ID: 5141
  Gene Symbol: DNHD1
  Gene Name: dynein heavy chain domain 1
  Uniprot ID: Q96M86
  ENST ID: ENST00000354685
  CDS Start-End: 663-2456
ttctaacagctgggtgcgggtggagctgcgggcgatcgccagctcgagtgcagattccttgctgtgaccgaggttcagagtgagctctgtcggtgtgtcagtttgcctcttcaggtgattgcacgtctgtgtgcgagtctctccgtgtatgggtggctatgattagggtgagcctcagactggaactcaagtctaagttcattcactgctccagcaggcactcttcaatgaaacctcatcagcagatcgggctctcttcccttgccttgcctcctaacccccctaggccaggtgagggggacagggtactgggaggtaagaaggaactcttctgcaaggagggctctcacgtctgtcttaggcctgctccttaccagagtctttggggaagcagtagggagggcctgagggtctcaggaaaggctctctgctggtctggctctgctctgtagctccatctatttccctgtcccaggtcctttcttcctcctaaccccattgactctgaccatcccctgcccagagcctgaggtcccttctctggcccctctgctgggctggcccatgcaggtgaggccccgcatctggcatcctggaactggcagttggagcctgagctatgggcaaggtcacttcgacagcagttgaatgcccagctcctcatggtcccggaggagaggagggtaggtttgtcttctgatgagacatcatctgattcccttaagtcttggcactccatatgtgtcttggacagcaaagaacagcccttggcctgccagcagaaacagaggcagttcgtgaagccagtgactgagtcagagcagcccacagtgctggaactcctgctagctgagctccgaactctgttctcagctgtgttgcaggacagtagccctgcagcttggcgctatcttcatgcagtactgggtctactgcctccatatcgtgagttgctagttggccaccttgatttgctgcccttcctggagcagctgtactgctgggcaccctgggtccaaacccacctccatctggacctgctaggtgccattgtccaggcctttcctccagacagctctttgttagacagtgcttcccatgctgactgctgtccccagaagcggaggctccatcacaggcccccatgcccagcttgcccttttgtgcaggcccagtggagcaggcagcaagtaaaggaggagctggccacctggctgcgaccattgacactgcctgagctacagcgctgcctgggcattgttggtgctcaggtggccctagaagaggctgtgtggctggatggacttagtctccttcccttggcactggcagcggacatccctgtacggtatgaaagcagtgacactgacaatgcagaggtggagcctgttggaagaaaagagaccaggtctcagcttgactatgaagttcccagggaaaaggccttccaaaagagcagcaccggcttttcacctgagacttccttcctggatagccaggtgatgactgctctgaagatggagagatacctgaagaagatccacttcctctatctcaatgtggctcccagccggtactttaggccttacagcctgatggtggtgccacccgacaaggtgaatcccgagcactacatcttctctccctttgggatcttgcatgtacatcctgtggaaggtagcgagacgatgacactgggtacctggcaccatcactgtgttctctggcagcagctccagttcattccattctttaagtattgcctcttacgcaagtcctttacctgttggaagaagaatgtgagattacaggggctgcatcgactccagaaattcctagagaatcatctgctcttggctgtgccccactttggagctgggctactccatattagcaggcttctgcaggagctacactctgtgtcctggctaccccaggaactggatcggtgctatgagctgctggacctgcagacggctctagccgaggagaagcataaggctctacggctgctccatcgttgcctaaacctctgcacatccattcttcgactggttcacgaggacacataccacatgcaacagtgcctacaggagcgagtacaaaactgtgacaggatcaggacaggccaaggctccatataccttcagagggtacagcacaagcaactggagcagaagctgaagcaagcagaggcctggtggctgcagctgggaaagtttgcccgcctggttgactacatgatttgtcagagcctcatttctgtcttggaagagcagataacctcttttgtggccaacatccttcaagccccaaggcagaaaccctttctctcatcacagctggtctttgatgatcatggtcaactgtctcatgtgccctgtgttgaaaatatgatccagactctaactggaggcctacagtctgtcaagacctctgccttgcaggtattctgaattgggcagagagctggctgtgggaattcccagttcctatcctctgagtaatcagaagctcacaacctggtttgaatccctcattgctttcccatttctgccccttctccatatcctggcatgaaggtagtgcagtctgcagacctgaagacctcctcggattccctgtattctgaaggtatttagggagacctaggcagggggtaggaaggctgaaggagggaaagggcacaagtactaatggcatgggaagaaggcaggaggtccaggctatagagtcaggcactgggtgtggatggagcagctctaacctgggtactgcacatatgtgttgtgggtagaaaggtcagggaatgtttttgctcacaaattcacgtggttatgtgtatgtgcgtgcaatgagagggtgtatgaaagagtgtgagtacattgtccttccaaacctgattcatcccaaactctgtgaggtttttctccagtgccataattgcatttcatttactactgaattttattgctaagtaaatttgtacttgtttgaagagctctgcttgctcaacacttgctttatgtcatatagctctttttcatttcatatggattaattcattgtattgaaatattttatggttaccaattattattggttatcagtcttcacacttattaaccatcagcgtggaaacacatcttcacatttcccttatttaggatactaatgctgtcacaaataaaatcattaaatgcaa

SEQ ID NO: 128438 - DNA, 1475 bp, Homo sapiens
  Payload ID: 5141
  Gene Symbol: DNHD1
  Gene Name: dynein heavy chain domain 1
  ENST ID: ENST00000524401
  CDS Start-End: 1-1082
aggaggccattctccaatgtctacgagatgccagctggcatgctggcatgttaagccagccagtggctctgttggtacccagtggtgtggatctcactacacttcatcgcctcctggccctggcaacctcaggcagtttccctggccagtacacagaagcagatttggaccgcattggagaacacctccccagggagaaccttggtgtcaaacagaacatcaagaaggaaatggtgttgcagaggttccaccagcaagtgtgcagccaccttcacctgttcttcctgattggagataaacaggcccacaagcagctgccctccacccttttcctgaggctccttcaactggccactgccagcattgaccgctatgaaccctgggaccaagctgccctggccaaggtggcccagcatcacctggagggtgctcagagtgtgccccttgatgacggctcctggaagtacccagacctccaggcctcaattcccagtgtggccaaagccatggctcttatccacctttcggccacccactaccatgagcacctgtgccctgcattgccactcgtcacccccaagaccttcctagacttcctggacactttcctgatgctgcagcaacagacaatcctgaagattaagaacaaggcccagcgggtccagaatgccttggagaatctgagaatgctgattaaggagcacggtacccatgccaatctgatctttgacttggaacagcagctgaaagactccggcaagagtctcagcatgtttcagcagcagctagagcaaagcaagctcctatacaagcagcagctggaagagtgtcggcatcaagagaacctcattgagaacctggccaggcaacgggatgccctgcaagctcagcgagaggctttcctggagcaggtgggctcttcctgccgcctgccctgcactgctcctctctcaaaagagggcaacccctctaaggataccaagaggagaggatggagtgactcatcatggaatctcctggggggaggggacaaagatgagcaaggcatttctggagcctctgagccagctgcaggtggctgactttgaggagatacggagctatcgagcaccaccagaatctgtggtccgggtaactgatgcaatgtgtgacttgttccaccatgaaacaggctgggccagtgccaaacagctgttatgcactgaggatttttatcaggctccaggtatggacgatgcagccctgcgggcagtgagccgacctgcagccagcctggcagcctggctctgggctgttctgcactatgggctggcgcattgccggggactgcccacggacctgctgctgcagcaagtggaggcaacactcactcgggagcaggcccgcctgggctactaccagtttcaggcccaggagaccctggagcataatttggccctggctaagatggtggaggatgcccaagcttcccacaa

SEQ ID NO: 128439 - DNA, 4881 bp, Homo sapiens
  Payload ID: 5141
  Gene Symbol: DNHD1
  Gene Name: dynein heavy chain domain 1
  ENST ID: ENST00000532027
  CDS Start-End: 1-477
tttgagaaaagccaggcttcagagttcctgctcagcaagcgacatgccattatgcccaagctgcagcagctgatggcagcagcattggcagagctggaaggcctgcttgcgaaggccctctccggtccctttatggaccccacacaagatcagaggagtactgagcaccagctcgtctccctagagcgtcagttccagaacacagtcagcgacctcagtgaactgcaccacgcctatgccatcttcactggtactgaggatccctgcaccctccattatcactctgtgatagacccttcaactgaaaggatgagactcctgtgcccttgccaatctgtgggacacgtcctattgtgcagcagcagcgcatatggcacctgtaccgagtcatctccgaaaacatcagcgagtggaagtgcatggcttttgccaagttcagcccagctatggcccaggagaagacagagggctggctgacagaggcagcacggatgagcacaaccctggagctgcacagccccgtgctgcagcactgcatgcgcatcctgggggagtttcgcagctacctgcccctgctcactaagctgggcagcctccacccacagagcctcaactgccagtgtctcctgcgtgcccttgggctgggcagtctccaaactatagaactcctaacgctgggccagctgcttacttatccactgctggagtttgcagatcgaatcaaccaggtctggcagaatgaaaatgaacgaattcatgcccaagagactatacggcggttgcagcggtactgggaagcgcgccagctgcgcctgctcaacttcatcctgcatgtaccctacgagcccccagcctcagagcgctccaagaggcaggtgctccgcagcccccaatgggaggtagtggacaaagatagtggcaccttcatcctctcagattacagcaacctgcaggattccatccaggaaagtcttcaggtgttgtccaagatcttggccatcgaaaagtcaggagatttaaacaaaatagctttggagtgggtggccatcatgcatggcctgggtgccctgctggaggtgtggctgactttccagcagaagtggatttttctgaataaagttctgcatgagatgaagatccagtttcctaatgctgacctgtgcccagtgccgagaggagcccttacttccaaggccagcagctgcaacaactgctgcaagcaggatcggtggagctggagggcatcatcatgagtctggagagcgtgctctatggggtgtgtgctcacttcccccgcctcttcttccttagtgacagtgagctggtagccctgctggctgctcgactggaatcatgcgaagcccagctatgggtacgacgctgctttcctcatgtgcatgctgtgagcttcaggtcttgcccaactggtgagaaaaacacagatgactgggagtcaagcccaaacacacagactcaggtggaggcacttgcagtgctaggggcaggtggggaggaggtgaagctgcagggtccccttcctctgcatccagatctccctaagtggctggcctctctggagaagtgtctgcgcttggcactggtgcacatgctgcagggctgtgtggctgctcgccttgctcgaggcccatctctaggtgaggccctcaagcaactgcccaagcaaaacaagttgtacctgcaactgtatgtccagcactggatcgacttagtccaggccttcccatggcagtgtgtgctggtggcagaggaggtggtatggcgggccgagatggaggaggctctgcttgagtggggtaccctggccatggtctccatgcatatgcgcaagcttgaggtactggtgaattttatgcgggcccagagggcttcccaaggtgggcagtccctgccttctgtccgccagaccagccttctcagtgccctgctggtcatggcagtgactcaccgggatatagcacagctgctggaacagcaccaggtcagtgatctcacagactttcactgggtccgccaactcaagtatcacttgggttcacctcacataatccccaaaagccccctacagagtcttaagactattgcatcttctgaaccctctctgtcaccagcggcatgctggatagatgtgctaggcaggtccttcctgtacaattacgagtatctgggacctagactagggcctctacccagcctactgcctgaacggccagccctggtactattattggccctagaggaggtggcctgtgggaccgtactgggtcctaatggtgtgggcaagagagctatagtgaacagcctggcacaggccctgggccgccagctggtgatgctaccctgctcacctcagatagaggctcaatgcctgagcaactatctgaatggtgccctgcagggtggtgcctggctgctgttggagaaagttcatcagctgccccctggcttgctctctgccctgggccagcgcctgggtgaactgcaccacttgtatgccccactgtaccaggaggcttcccgaaacacaagcaccatagaccccacccagccccagctccttggcagtagcttctttgaaaaacatcacgtgtctgtgcgccttggctatggctgtctcctggtactgcgtgccctgagctctgctgtgcctgccaacctgcacctgctgctgcggcctgtggcattggcattgcctgatctgcggcaagtggcagagctgactctgctgggtgcagggatgagggatgccttccagatggctacccgcctatccaaattcttctctctagagcgtgagctggtgtctgggcccctgccctgccgcctgccactgctcaagcagatactggaagacacaatacggacactaaatgtgaccaaggaggaaccgaagtgccagaagcctcgcagcctagctgccattgaggaggctgccctactgcgctcaccactgtttagcattctcaatgggctccacctgcacaacctccgagggctgttgtgtgcgcttttccctagcgccagccaagtgctggcagaacctatgacttacaagctgatgaagccattggtggtggaggaactgcaacaggtaggtctggatcccagccctgacattttggggtccttggaacagttgagccaggccctgagccgggcctcaggcattctgctcctgggccctgcgggcagcggcaagaccacttgttggcacagcttatttaagatccagaatcggctggcagccatggaggacacctcaacccaaggctgccagcctgtggaaattacccacctgtaccccagtggcctcagcccccaggagttcctgggatggctagagggctcctgctggcatcatggcatctttcccaaggtacttcgtgcagccggtcagtgtaacaacatgggccaaaagaggcagacagaggaatcaatcgggatccagcactggataatatgtgatggagcctccaatggtgcttggctggactccatcacttgcctcctgagtgagcttccccagcttagtctccccagtggacagcagatagcacgacccccaggcacctttctcttgatggaggtggctgacacaacaggcatatcccccacagtggtaggctgttgtgccctagtctggtgtggtggagagcagacttggcagtgtatacttagtgccctgatggcatcccttccttatgagtaccgcctgcagcaccggacagtcgctgagctcaaccacatggctgaggttctggtgcctgcaacattgcgattcctcacctgccaaggtgtcagctctctgctgcaggtacacgggcagcaggctgtttgtgcaggtgtggcagaagttaccagcatggcacgcatcttgcatagtctgcttgacctccaccttcgcctaaaggaggagaaggcccctggcccagaggacctcagctatagtgatcctgtggcccaaagcttcaggtcttcaaaaagcagctttctaaaccggtcccaggttgacagtgacgatgtgccagataagtgcagggaacacttgctggctgtcagcagttttctttttgccttgatctggggctttggagcccaccttccctccaggtacctaccaggatgggggatgggagatgcagagggctgagatggactggcccatggaagtaaaaacccacatgacatcactgttagggtatggtggagtgtgtgagtgtgtcataaatggaagtgttgtaactgtctgacgcttttgcctgtgtgtccatctgagcaggttctggcccatctttgataccttcataagggattctattagtcgcctctccaactaccctgagccaccaccctcagccttggtgtttgatctacatgtaagccctgaagatggaacactggtccccttcactggccaatacctgagcagccacatcaaaggaactttgggcacctttcacccttctatccagactgaacggctcttgtatgtggtggacctgcttctgtcagggggacagccagtgttgctggctggagaggcagcaacagggaagtcagcctttgtggaggtgctggtagagccacatcacccttacatatacagccccatccaccctgccttcagttcctcccacctccgtctcctgctgagcagaggaatccagggccaaacacaagccagcccacagcctgggcatcaccaggattctaaaccctccctcctcttcttgctggaggacctgcacctagccacttctggtgaggagctgcgaagagggaaggaaggagctactgtcatctcttgagactataaaatccctagcaatattcattgactctcaaatatatgtctgtagatct

SEQ ID NO: 128440 - DNA, 14298 bp, Homo sapiens
  Payload ID: 5141
  Gene Symbol: DNHD1
  Gene Name: dynein heavy chain domain 1
  Uniprot ID: Q96M86
  ENST ID: ENST00000527990
  CDS Start-End: 1-14262
atggtcccggaggagaggagggtaggtttgtcttctgatgagacatcatctgattcccttaagtcttggcactccatatgtgtcttggacagcaaagaacagcccttggcctgccagcagaaacagaggcagttcgtgaagccagtgactgagtcagagcagcccacagtgctggaactcctgctagctgagctccgaactctgttctcagctgtgttgcaggacagtagccctgcagcttggcgctatcttcatgcagtactgggtctactgcctccatatcgtgagttgctagttggccaccttgatttgctgcccttcctggagcagctgtactgctgggcaccctgggtccaaacccacctccatctggacctgctaggtgccattgtccaggcctttcctccagacagctctttgttagacagtgcttcccatgctgactgctgtccccagaagcggaggctccatcacaggcccccatgcccagcttgcccttttgtgcaggcccagtggagcaggcagcaagtaaaggaggagctggccacctggctgcgaccattgacactgcctgagctacagcgctgcctgggcattgttggtgctcaggtggccctagaagaggctgtgtggctggatggacttagtctccttcccttggcactggcagcggacatccctgtacggtatgaaagcagtgacactgacaatgcagaggtggagcctgttggaagaaaagagaccaggtctcagcttgactatgaagttcccagggaaaaggccttccaaaagagcagcaccggcttttcacctgagacttccttcctggatagccaggtgatgactgctctgaagatggagagatacctgaagaagatccacttcctctatctcaatgtggctcccagccggtactttaggccttacagcctgatggtggtgccacccgacaaggtgaatcccgagcactacatcttctctccctttgggatcttgcatgtacatcctgtggaaggtagcgagacgatgacactgggtacctggcaccatcactgtgttctctggcagcagctccagttcattccattctttaagtattgcctcttacgcaagtcctttacctgttggaagaagaatgtgagattacaggggctgcatcgactccagaaattcctagagaatcatctgctcttggctgtgccccactttggagctgggctactccatattagcaggcttctgcaggagctacactctgtgtcctggctaccccaggaactggatcggtgctatgagctgctggacctgcagacggctctagccgaggagaagcataaggctctacggctgctccatcgttgcctaaacctctgcacatccattcttcgactggttcacgaggacacataccacatgcaacagtgcctacaggagcgagtacaaaactgtgacaggatcaggacaggccaaggctccatataccttcagagggtacagcacaagcaactggagcagaagctgaagcaagcagaggcctggtggctgcagctgggaaagtttgcccgcctggttgactacatgatttgtcagagcctcatttctgtcttggaagagcagataacctcttttgtggccaacatccttcaagccccaaggcagaaaccctttctctcatcacagctggtctttgatgatcatggtcaactgtctcatgtgccctgtgttgaaaatatgatccagactctaactggaggcctacagtctgtcaagacctctgccttgcaggtagtgcagtctgcagacctgaagacctcctcggattccctgtattctgaagaagaagatgaagaggaggactcaaaagacgaatttctgatgcccaagttccagggccagcccagcgatgctgtgagcatcttctgtggcccgaatgtgggattggtgtggccctggaagtctcacccaattgctggtatcttggaggtccgtggatgtcggctgcggggccaatacttcccccacaattataagcagctggaggaagacctggacaacaaccctaagatccagcaggcactgaatatacaacaggtgctgctggagggcgtgctgtgcaaggtgcaggaattctgcagggaacatcattggataacaggcatttatgaattcctgcaatcctgggggcctcagaagctggaagacatgagaggtggtcccatcaagaactacgtgacgctggtgagccgcctgaatgtttggcaggcccgtgtctccagtatgcctatcgagttgctcacaaaaggcgggttgctgctacttagctgccatgatgtacaggcagagatggaatccaagctgaacagcataaggaaggacattcttgcacacgtgcaaaatgagtgctggaacctcagtcaacaactcatgacagagctcacagatttcatgcatatcttccgaaccatcaactcagatattcatgccattgcacagtgcacccagaagttgaatgaagccaatgaacagtacgtcgagctggaggagcgaatggaatacgtacgggcactccacgaactcatccgcaaccactttagcctctttagtgctgagaatgaagcactggacatctcggtgagaaggcaattcggggagtcacccatccctccctgccctcctcccccacaaccacatctactccactgccctctgcttgccccacagcttctggatatgtgggaggcatttcagtttgagaaaagccaggcttcagagttcctgctcagcaagcgacatgccattatgcccaagctgcagcagctgatggcagcagcattggcagagctggaaggcctgcttgcgaaggccctctccggtccctttatggaccccacacaagatcagaggagtactgagcaccagctcgtctccctagagcgtcagttccagaacacagtcagcgacctcagtgaactgcaccacgcctatgccatcttcactgaggatgagactcctgtgcccttgccaatctgtgggacacgtcctattgtgcagcagcagcgcatatggcacctgtaccgagtcatctccgaaaacatcagcgagtggaagtgcatggcttttgccaagttcagcccagctatggcccaggagaagacagagggctggctgacagaggcagcacggatgagcacaaccctggagctgcacagccccgtgctgcagcactgcatgcgcatcctgggggagtttcgcagctacctgcccctgctcactaagctgggcagcctccacccacagagcctcaactgccagtgtctcctgcgtgcccttgggctgggcagtctccaaactatagaactcctaacgctgggccagctgcttacttatccactgctggagtttgcagatcgaatcaaccaggtctggcagaatgaaaatgaacgaattcatgcccaagagactatacggcggttgcagcggtactgggaagcgcgccagctgcgcctgctcaacttcatcctgcatgtaccctacgagcccccagcctcagagcgctccaagaggcaggtgctccgcagcccccaatgggaggtagtggacaaagatagtggcaccttcatcctctcagattacagcaacctgcaggattccatccaggaaagtcttcaggtgttgtccaagatcttggccatcgaaaagtcaggagatttaaacaaaatagctttggagtgggtggccatcatgcatggcctgggtgccctgctggaggtgtggctgactttccagcagaagtggatttttctgaataaagttctgcatgagatgaagatccagtttcctaatgctgacctgaactctcgtttcaaggtcatggatgaccagtatcgaaccctgatgcgcatctctgtagctgaccccatggttctgtcacttgtagtgcccagtgccgagaggagcccttacttccaaggccagcagctgcaacaactgctgcaagcaggatcggtggagctggagggcatcatcatgagtctggagagcgtgctctatggggtgtgtgctcacttcccccgcctcttcttccttagtgacagtgagctggtagccctgctggctgctcgactggaatcatgcgaagcccagctatgggtacgacgctgctttcctcatgtgcatgctgtgagcttcaggtcttgcccaactggtgagaaaaacacagatgactgggagtcaagcccaaacacacagactcaggtggaggcacttgcagtgctaggggcaggtggggaggaggtgaagctgcagggtccccttcctctgcatccagatctccctaagtggctggcctctctggagaagtgtctgcgcttggcactggtgcacatgctgcagggctgtgtggctgctcgccttgctcgaggcccatctctaggtgaggccctcaagcaactgcccaagcaaaacaagttgtacctgcaactgtatgtccagcactggatcgacttagtccaggccttcccatggcagtgtgtgctggtggcagaggaggtggtatggcgggccgagatggaggaggctctgcttgagtggggtaccctggccatggtctccatgcatatgcgcaagcttgaggtactggtgaattttatgcgggcccagagggcttcccaaggtgggcagtccctgccttctgtccgccagaccagccttctcagtgccctgctggtcatggcagtgactcaccgggatatagcacagctgctggaacagcaccaggtcagtgatctcacagactttcactgggtccgccaactcaagtatcacttgggttcacctcacataatccccaaaagccccctacagagtcttaagactattgcatcttctgaaccctctctgtcaccagcggcatgctggatagatgtgctaggcaggtccttcctgtacaattacgagtatctgggacctagactagggcctctacccagcctactgcctgaacggccagccctggtactattattggccctagaggaggtggcctgtgggaccgtactgggtcctaatggtgtgggcaagagagctatagtgaacagcctggcacaggccctgggccgccagctggtgatgctaccctgctcacctcagatagaggctcaatgcctgagcaactatctgaatggtgccctgcagggtggtgcctggctgctgttggagaaagttcatcagctgccccctggcttgctctctgccctgggccagcgcctgggtgaactgcaccacttgtatgccccactgtaccaggaggcttcccgaaacacaagcaccatagaccccacccagccccagctccttggcagtagcttctttgaaaaacatcacgtgtctgtgcgccttggctatggctgtctcctggtactgcgtgccctgagctctgctgtgcctgccaacctgcacctgctgctgcggcctgtggcattggcattgcctgatctgcggcaagtggcagagctgactctgctgggtgcagggatgagggatgccttccagatggctacccgcctatccaaattcttctctctagagcgtgagctggtgtctgggcccctgccctgccgcctgccactgctcaagcagatactggaagacacaatacggacactaaatgtgaccaaggaggaaccgaagtgccagaagcctcgcagcctagctgccattgaggaggctgccctactgcgctcaccactgtttagcattctcaatgggctccacctgcacaacctccgagggctgttgtgtgcgcttttccctagcgccagccaagtgctggcagaacctatgacttacaagctgatgaagccattggtggtggaggaactgcaacaggtaggtctggatcccagccctgacattttggggtccttggaacagttgagccaggccctgagccgggcctcaggcattctgctcctgggccctgcgggcagcggcaagaccacttgttggcacagcttatttaagatccagaatcggctggcagccatggaggacacctcaacccaaggctgccagcctgtggaaattacccacctgtaccccagtggcctcagcccccaggagttcctgggatggctagagggctcctgctggcatcatggcatctttcccaaggtacttcgtgcagccggtcagtgtaacaacatgggccaaaagaggcagacagaggaatcaatcgggatccagcactggataatatgtgatggagcctccaatggtgcttggctggactccatcacttgcctcctgagtgagcttccccagcttagtctccccagtggacagcagatagcacgacccccaggcacctttctcttgatggaggtggctgacacaacaggcatatcccccacagtggtaggctgttgtgccctagtctggtgtggtggagagcagacttggcagtgtatacttagtgccctgatggcatcccttccttatgagtaccgcctgcagcaccggacagtcgctgagctcaaccacatggctgaggttctggtgcctgcaacattgcgattcctcacctgccaaggtgtcagctctctgctgcaggtacacgggcagcaggctgtttgtgcaggtgtggcagaagttaccagcatggcacgcatcttgcatagtctgcttgacctccaccttcgcctaaaggaggagaaggcccctggcccagaggacctcagctatagtgatcctgtggcccaaagcttcaggtcttcaaaaagcagctttctaaaccggtcccaggttgacagtgacgatgtgccagataagtgcagggaacacttgctggctgtcagcagttttctttttgccttgatctggggctttggagcccaccttccctccaggttctggcccatctttgataccttcataagggattctattagtcgcctctccaactaccctgagccaccaccctcagccttggtgtttgatctacatgtaagccctgaagatggaacactggtccccttcactggccaatacctgagcagccacatcaaaggaactttgggcacctttcacccttctatccagactgaacggctcttgtatgtggtggacctgcttctgtcagggggacagccagtgttgctggctggagaggcagcaacagggaagtcagcctttgtggaggtgctggtagagccacatcacccttacatatacagccccatccaccctgccttcagttcctcccacctccgtctcctgctgagcagaggaatccagggccaaacacaagccagcccacagcctgggcatcaccaggattctaaaccctccctcctcttcttgctggaggacctgcacctagccacttctgacccagagaagagctgccagccagtgttggagactctgcgccaggccatggatggcactgtgtatgcccacagcaccttggaactgcagacgctgcagcctacagtcaacttccttgccactgtcacagtgccaggatactgtgagcgcccactgtgtccacgcctctttcgactcttcacagtcctggccctggaaagcatgacccaggccaccctgctggaaagacatgtgcctatcattcaggcttggcttgagcgtttcccttctgtggaacgggagcgtgctctggcacgaggtctggttagggcctcagtagaggcctgggaggctgtgtgcaattgcttcatgccttcacccctccacccacactaccacttctccctacactctgtgagccacctactgagcagcctgcagctgctgcccaacagaacaggctcccgaggttttgtggactatcccaaccaccaggagcacttgcgccgggtgtcaggcctgcgaggcacttgtctgaccgttatgatggccacacgcaatgtggtgcgtctttggttgcatgaggcacagagaaccttttgcgaccggctggacagccccagggaacgctcctactgtgccaagctgctcctagtagtagctcaaagtgtcttctgctgtgggccagggccccagcacctgggcaaggaccatcaggagagtgaggaggaggaggaggaggagagggtgcccgaagtagaatctgaaggggagttggcccagtgggaggacttcagcaacagcaatagtgaaacagaggaggaagaggaaccttatggccttcaggtcgccagagtctcaaactccagagatccaagtctaacaccatccataggaccagtaagcagggggatgaaggaaagcataagtcacaagataaggcaagagaaaggcacaagggcatccaactataggctccaggtaaggagatcattcaagacttggtggcagaagaaaccccagatggacctgatctcacccttgttgttaccagtgttactactacatccccaggaaaagccctcagacctggtcttcagtcaggagctgatactggggcctaactctgagacccccaacttgtacctggaacgacagtgggagaagctagaggagcagttggccacctcagctgctcaactgaagttgagcccccacctggcccggtgtcattccatggcccagcacgtggcccgcctggtccgggtgctggccaggccccggcagcatggcctgctgctctcgggggctctgggtactgggcgccacactgccatcactctggcttctagcatttgtcaggcccatttctttcatctaccatctgggtcagaggaggccattctccaatgtctacgagatgccagctggcatgctggcatgttaagccagccagtggctctgttggtacccagtggtgtggatctcactacacttcatcgcctcctggccctggcaacctcaggcagtttccctggccagtacacagaagcagatttggaccgcattggagaacacctccccagggagaaccttggtgtcaaacagaacatcaagaaggaaatggtgttgcagaggttccaccagcaagtgtgcagccaccttcacctgttcttcctgattggagataaacaggcccacaagcagctgccctccacccttttcctgaggctccttcaactggccactgccagcattgaccgctatgaaccctgggaccaagctgccctggccaaggtggcccagcatcacctggagggtgctcagagtgtgccccttgatgacggctcctggaagtacccagacctccaggcctcaattcccagtgtggccaaagccatggctcttatccacctttcggccacccactaccatgagcacctgtgccctgcattgccactcgtcacccccaagaccttcctagacttcctggacactttcctgatgctgcagcaacagacaatcctgaagattaagaacaaggcccagcgggtccagaatgccttggagaatctgagaatgctgattaaggagcacggtacccatgccaatctgatctttgacttggaacagcagctgaaagactccggcaagagtctcagcatgtttcagcagcagctagagcaaagcaagctcctatacaagcagcagctggaagagtgtcggcatcaagagaacctcattgagaacctggccaggcaacgggatgccctgcaagctcagcgagaggctttcctggagcagatgagcaaggcatttctggagcctctgagccagctgcaggtggctgactttgaggagatacggagctatcgagcaccaccagaatctgtggtccgggtaactgatgcaatgtgtgacttgttccaccatgaaacaggctgggccagtgccaaacagctgttatgcactgaggatttttatcaggagctggtgttcttccccaaggagaagataacagactcagagctgataaagttacatctaattctgaaggctccaggtatggacgatgcagccctgcgggcagtgagccgacctgcagccagcctggcagcctggctctgggctgttctgcactatgggctggcgcattgccggggactgcccacggacctgctgctgcagcaagtggaggcaacactcactcgggagcaggcccgcctgggctactaccagtttcaggcccaggagaccctggagcataatttggccctggctaagatggtggaggatgcccaagcttcccacaactgcgtggcaaagaccctcagtcaagcacagtgtgggcagtatcacaaatggcccatgaaggctgcactgctcacgcctatgcgtgcctggactacacagctccagaagctgaagggacgctgcatgactgtgtttggagataccctcctatgttcagctgccatcatctacctgggtcccttcccaccattgcggcgccaagagctactggacgagtggttagctctgtgtaggggctttcaggaggctctgggcccagatgatgtggcacaggcactgaagcggaagcaaaaatctgtcagcataccaccaaagaaccccctgctggctacacactctcccttcagtattctgtccttgctgagctctgaatcggagcagtaccagtgggatggaaacctgaagccacaggcaaagtcggcccacctggcaggcttgcttctgcgaagccccacacactacagtagttgccgttggcctctgctgcttgaccccagcaacgaggccctcatctggttggacccgctgcctctggaagagaatcgatcttttgcgccagccctcactgagggtagagggaaaggcctcatgagaaatcaaaagagagagagtaaaacggacatgaaagaggaagatgatgagagtgaagagagtaatgaggctgaggaccagacaaaagagcagaaggcagaggaaagaaaaaatgagcaggagaaagagcaagaggaaaatgaagagaaagaggaggagaagacagagagccaggggtcaaagccagcctatgagactcagcttccatcccttccctaccttagtgttctttcaggtgctgacccagagctgggttctcagctccaggaggcagctgcttgtggcctgcctgtgttactgaccaatgtggagctgggtctagggtgcgaagaactgcaatggctgctgcaacgggagcagctgagtccaccccaggtgcagcctggcttctgtctgtatctcagcaccaccctctccctctgtgccatggaaaaagtgctaggttgtgaactgctaaaggggctgaatgtgttggatctgggcctgaacatggaaatactggaagaacagatgctgcatgaaatcttgtgcagagagtatcctgaactcgagacccgctggcaggacctaaagatcagagccctagatacctgcaaggctgtggaggctgctgaggagcggctgctgacgatgctgctgttccagaatccgaagcgtcagaagccagccaagtttctgcggaacatagtgagggcccaaggaaagctatgccagctgcgtgctcattgtgaagagttagaagggcagaaactacaggagatggtattgtgggcaccctatcgacctgtggtttggcatggaatggccatggtaaaggccctaagccaactgcagaacctgctgccacttttctgtatgagcccagagaactggctggcagtcactaagcaggctctggacagcatgaagccacgtgagattaatcacggggaggacctggccagccatctactgcaattgagagcacacctgacccgccagctgctgggcagcaccgtgactgcactgggccttacccaagtacccttggtgggtgcattgggcgctttggctctgctgcaagcaacagggaaagcatcagagctggaaagactggcactctggcctggactagcagcctctcccagcacagtccacagcaagccagtctcagatgtggctcgaccggcctggcttgggccaaaagcctggcatgaatgtgagatgttagagctgctgcccccatttgttggcctgtgtgcctccctggcaggccactccagtgcttggcaggcttacctgtcactgtcatccacagtgctgggtcctgcacctgggccagggcctgagccactcagcctcctccagaagctgatcctgtggcgcgttctgcgacctgagtgcctggcaggtgccctggcagacttcaccactagcctcctgggtcggcccctggatgaaaacacgtatgctcccaccatgccctttaaacatagtcaggctactcagcccatgctgatcttgttgccaccgcctggccacccctcagccactctgcatcctctgactgtcatccagaaactggctgccaagtatcagcaggggcagaagcaactgcaggtgatagccctgggctctgaagcctgggacccagtctcagttgtggtcagcactctatcccaggctatgtatgaggggcactggctggtgctggacaactgtcatctgatgccccattggccgaaagagctgctacagctcttgctggaactgttaggcagagccaaggtggttgcagacctggaatcagaacagcttttagaccaacctgaaagcaggaatgtaagcactgttcacagagattttcgtctttggcttattgtgcctgcagagtctagtgcttctttgccagctgtgctgactcagcactccatgcctgttttctggaaccagtccctggagctgggccatgttttgattgacagtgtggagctagcccagcaagtactctacatgcaaccccccacccaggcactacctctgctcctcctccatggcctcctgctacaccggcagctctatggaacaaggctgcaggcacacagggggcgctggagtcaagtgactctaacccaggttcttcagacccaagaccagctgtgggcaagtcttagcaatccccgtgctgccatgcaagagctggctgcttcagttttctacgggggtcctctgggggacactgaggacagggaggccctgattagcctcacacaagcctgcctgagccccagtagtgggagctgggtccagccacacacacctcagtctttgctggccacgctcatgcccctcccagagctaagggagctggatgcaatggcagagtgcaaggcccagatgcacctactgccctcaccacctgaaccccggctctgcggactgagtgagggcccccaagcctggctgttgcgacgccagagtcgcgctctcttgagtgcgctgcagcggagttcacccgtgtgggttcctgagtctcgaagaggcgcccagcttgcggaaaggcgactgcggcaacgcctagtgcaagtcaaccggaggctggagtcactgcaggatctgctgacccacgtgattcgccaagacgagtccgacgccccgtggtcagtgctggggccaaatgcacggcggcctctggagggcgtcttagagaccgaggctctagaactgagccagttggtgggcacgctacaacgcgaccttgattgcctgttgcagcagctgaagggcgcacccccgtgcccctcccgccgctgtgctgcggtggcccacgctctctggactggccgcctacccttgccttggcgacctcatgcgccggccggtccgcagccgccctggcactggctgcgacagttgtcgcgccgtgggcaactgttggttcgttacttgggcgtgggcgcggacgcgagcagtgatgtaccagagcgcgtcttccacctgtcagcctttcgccacccgcgccgcctgctgctggcattgcgtggggaagctgccctggaccagaatgtgcccagctcgaatttccctggtagccgaggctcggtctccagtcagctccagtataaacgtctggagatgaacagcaaccctctgcacttcagggtggagaatggtccaaatcccacggttccagagagagggctgctgctgatcgggctacaggtcctacatgcggagtgggacccaatagctggagccttgcaggacagtccttccagccaacccagccctctgcctcccgtcagcatcagcacacaggccccgggcaccagtgacctgccagccccagccgacctgactgtgtactcgtgtcctgtgtacatgggagggccccttggcaccgctaagctgcagagcaggaacatcgtgatgcatctgcctttacccaccaagctcacccccaacacctgtgtccaaaggagggtccatgtgtgcagcccacccctgtcttgagcccgtctaccaaaataaagttgtagtgattccatg

SEQ ID NO: 128441 - DNA, 587 bp, Homo sapiens
  Payload ID: 5141
  Gene Symbol: DNHD1
  Gene Name: dynein heavy chain domain 1
  ENST ID: ENST00000525080
  CDS Start-End: 1-587
aaggggctgaatgtgttggatctgggcctgaacatggaaatactggaagaacagatgctgcatgaaatcttgtgcagagagtatcctgaactcgagacccgctggcaggacctaaagatcagagccctagatacctgcaaggctgtggaggctgctgagaatccgaagcgtcagaagccagccaagtttctgcggaacatagtgagggcccaaggaaagctatgccagctgcgtgctcattgtgaagagttagaagggcagaaactacaggagatggtattgtgggcaccctatcgacctgtggtttggcatggaatggccatggtaaaggccctaagccaactgcagaacctgctgccacttttctgtatgagcccagagaactggctggcagtcactaagcaggctctggacagcatgaagccacgtgagattaatcacggggaggacctggccagccatctactgcaattgagagcacacctgacccgccagctgctgggcagcaccgtgactgcactgggccttacccaagtacccttggtgggtgcattgggcgctttggctctgctgcaagcaacagggaa

SEQ ID NO: 128442 - DNA, 433 bp, Homo sapiens
  Payload ID: 5141
  Gene Symbol: DNHD1
  Gene Name: dynein heavy chain domain 1
  ENST ID: ENST00000527143
  CDS Start-End: 1-427
gtccctggagctgggccatgttttgattgacagtgtggagctagcccagcaagtactctacatgcaaccccccacccaggcactacctctgctcctcctccatggcctcctgctacaccggcagctctatggaacaaggctgcaggcacacagggggcgctggagtcaagtgactctaacccaggttcttcagacccaagaccagctgtgggcaagtcttagcaatccccgtgctgccatgcaagagctggctggtggagaatggtccaaatcccacggttccagagagagggctgctgctgatcgggctacaggtcctacatgcggagtgggacccaatagctggagccttgcaggacagtccttccagccaacccagccctctgcctcccgtcagcatcagcacacaggccccgggcaccagtgacctgcc

SEQ ID NO: 128443 - DNA, 581 bp, Homo sapiens
  Payload ID: 5141
  Gene Symbol: DNHD1
  Gene Name: dynein heavy chain domain 1
  ENST ID: ENST00000496802
  CDS Start-End: 565-581
aacggttctaacagctgggtgcgggtggagctgcgggcgatcgccagctcgagtgcagattccttgctgtgaccgaggttcagagtgagctctgtcggtgtgtcagtttgcctcttcaggcactcttcaatgaaacctcatcagcagatcgggctctcttcccttgccttgcctcctaacccccctaggccaggtgagggggacagggtactgggaggtaagaaggaactcttctgcaaggagggctctcacgtctgtcttaggcctgctccttaccagagtctttggggaagcagtagggagggcctgagggtctcaggaaaggctctctgctggtctggctctgctctgtagctccatctatttccctgtcccaggtcctttcttcctcctaaccccattgactctgaccatcccctgcccagagcctgaggtcccttctctggcccctctgctgggctggcccatgcaggtgaggccccgcatctggcatcctggaactggcagttggagcctgagctatgggcaaggtcacttcgacagcagttgaatgcccagctcctcatggtcccggaggagag

SEQ ID NO: 128444 - DNA, 2491 bp, Homo sapiens
  Payload ID: 5142
  Gene Symbol: DRC1
  Gene Name: dynein regulatory complex subunit 1
  Uniprot ID: Q96MC2
  ENST ID: ENST00000288710
  CDS Start-End: 75-2297
gtttgttcctagcaaccagcctgaggtctggaggtggtgcggagggagccgcctagggaccagggactcctgccatgaatccgccggggtccctagaggccctggacccgaacgtggacgagcacttgtccacccagattctcgcgccctcggtccactccgacaactctcaggagcgcatccaggcccggcgcctccgcatcgctgcgcgcttagaagcccggaggcgggaagcacttggagaatatttagatgggaagaaggagagtgaggaggatcaaagcaagagctacaaacagaaagaagaaagccgattgaaattggctaaacttctgctctgtggcaccgagttggtgacaaatatccaggtggctatagatatcagagagattcacaggagagtcgaagaagaggagataaagcgtcaaaggattgagaagctggagaatgaagttaagaccagccaggacaaattcgatgaaatcacctcaaagtgggaagagggcaagcagaagagaattccccaagagctgtgggaaatgctcaatacccaacagctgcactgtgctggactcttagaagataagaataaactcatcagcgagttacagcaggagttaaaaacaaaggatgaccagtatgtgaaggatttgaagaaacagtcagatgacatctgcctgcttctggagcggatggaagaacaggtgaagaatgtgatgaaaacctttcgtgaggagctctataacattgagaaagcatttgaggtggaacgccaagagctactggccagtaataagaagaaatgggagcaagcccttcaggctcataatgccaaagagctggagtatcttaacaaccgcatgaagaaagtagaggactatgagaagcagctgaacaggcagaggatctgggattgcgaagaatacaacatgatcaagatcaagctggagcaggatgtgcagattcttgagcagcagcttcagcagaggaaagcaatttatcagctaaaccaagagaaattagagtacaacttgcaggtgctgaagaagagagatgaagaaagcacagtaattaaatcccagcagaagaggaagatcaatcgcctgcatgatatacttaacaatctgagatcaaaatatgccaagcaaataaagcagtttcaggaggagaaccagtctctaacctcggactacaaacgtcttgtgatgcaattcaaggagctacagaaagccatgaggcattttgctcttattgatgatgagaagttttgggagatttggctgatgaatgaagaggaggcgaaggacctaatagccagagcctttgatgtggacaggatcatccacacccatcatctggggcttccctgggcagcacctgatttctggttcctgaacaatgttgggcctatttctcagcagccccagaagtccgccacacagatagtagaagaaatgcttatgcgctcagaagaggaggaggcagaagaggccgccgcggaaccagagtcctacctggatttgccgaagcaaatttctgaaaaaactaccaagaggatcctgatgctcctgtgtgacgagtcggggttcctcatagagagcaagctgctgagccttctcctgcccctggagcagaatgaatgctatctgctgaggctggatgccatcttctccgcccttggaattgaaagtgaggatgacttgtataaactggtgaacttcttccttaaatatcgagctcaccgtttatcttccagcctccagatcaagccctgcagtcaggcgagcatggagaaggcgagcatggaggagacaagcacgaggtcagaattggagctggcagagcagacggagatggagggagaaaaggaagaaagcctggtggaaggggagaaggaggaagaggaggagaccccaccctccccctgggtcatccaccccaatgatgtcctcaagattctggaggccttcgtcatgggtctgaagaagcctagggactcgcgggccccgctgagggtacagaagaatgtgcgtgacaactccaaggactcggagtactggcaggccctgaccacagtgatcccttcctccaagcagaacctctgggatgccctctacacagccttggagaagtaccaccttgtcctgacccagagggccaagctgctgctggaaaacagttctctggagcagcagaacacagagctgcaggcgctactgcagcagtatctgaactccaagatcaactctgaactgcaagttcctcccactcaggtgttgcgggtacccacaaaatgagctggaccgccaaaggctgatgtgttagggctggcctgatgctggtgtctgtgccggagccagctcatatcacccactgggccgcacctgggcctgctctctggattttccagggctgtctttatagcctgtcgaaataaggagccagaggagttacctgtgtcctgcattatgattaaagccttttaaagttg

SEQ ID NO: 128445 - DNA, 1075 bp, Homo sapiens
  Payload ID: 5142
  Gene Symbol: DRC1
  Gene Name: dynein regulatory complex subunit 1
  ENST ID: ENST00000421869
  CDS Start-End: 53-415
gaggtctggaggtggtgcggagggagccgcctagggaccagggactcctgccatgaatccgccggggtccctagaggccctggacccgaacgtggacgagcacttgtccacccagattctcgcgccctcggtccactccgacaactctcaggagcgcatccaggcccggcgcctccgcatcgctgcgcgcttagaagcccggaggcgggaagcacttggagaatatttagatgggaagaaggagagtgaggaggatcaaagcaagagctacaaacagaaagaagaaagccgattgaaattggctaaacttctgctctgtggcaccgagttggtgacaaatatccaggtggctatagatatcagagagattcacaggagagtcgaagaagaggagataaagcgtcaaaggagttaaaaacaaaggatgaccagtatgtgaaggatttgaagaaacagtcagatgacatctgcctgcttctggagcggatggaagaacaggtgaagaatgtgatgaaaacctttcgtgaggagctctataacattgagaaagcatttgaggtggaacgccaagagctactggccagtaataagaagaaatgggagcaagcccttcaggctcataatgccaaagagctggagtatcttaacaaccgcatgaagaaagtagaggactatgagaagcagctgaacaggcagaggatctgggattgcgaagaatacaacatgatcaagatcaagctggagcaggatgtgcagcctgcatgatatacttaacaatctgagatcaaaatatgccaagcaaataaagcagtttcaggaggagaaccagtctctaacctcggactacaaacgtcttgtgatgcaattcaaggagctacagaaagccatgaggcattttgctcttattgatgatgagaagttttgggagatttggctgatgaatgaagaggaggcgaaggacctaatagccagagcctttgatgtggacaggatcatccacacccatcatctggggcttccctgggcagcacctgatttctggttcctgaacaatgttgggcctatttctcagcag

SEQ ID NO: 128446 - DNA, 2064 bp, Homo sapiens
  Payload ID: 5143
  Gene Symbol: DRC3
  Gene Name: dynein regulatory complex subunit 3
  Uniprot ID: Q9H069
  ENST ID: ENST00000313838
  CDS Start-End: 291-1862
gtgtttcaccacacggagatgtggtcacgtgacttgtcaactttcacccaggatgtctcccttctgacttccccttagcaaccaagtcgcggcgcttggttccccagcaaccgggagacgcgtctgctgcgtggaaccgccgagttcccagcgcttgagaaggaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgatgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacaaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcgatgcgctcatgacgctggagatgcagctggtggagcagctggaggagactataaacatgtttgaaaggaacattgttgacatggtaggactgtttatcgaaaatgtccaaagcctaatggctcagtgccgggacctggagaatcaccaccacgagaagctcctggagatctctatcagcaccctggagaagattgtcgagggcgacctggacgaggacctgcctaacgacctgcgcgcgctttttgtcgataaagatacgattgttaatgctgtcggggcatcgcacgacatccacctcctgaagattgacaatcgagaagatgagctggtgaccagaatcaactcttggtgtacacgtttaatagacaggattcacaaggatgagatcatgaggaaccgcaagcgcgtgaaggagatcaatcagtacatcgaccacatgcagagcgaactggacaacctggaatgtggcgacatcctagactagatgaatgtcagccacaggagcttcttcaaaacatagcaccagccccagccaggagaaggaagtgcacacgcctcacccgcacctctagagagttgctgggcatctctcaaccgcgatccccaacaccattcttcccccacccctggaaaaacttccaaaagtagagaaaataaaggactcatttcacatttcccctactcat

SEQ ID NO: 128447 - DNA, 1923 bp, Homo sapiens
  Payload ID: 5143
  Gene Symbol: DRC3
  Gene Name: dynein regulatory complex subunit 3
  Uniprot ID: Q9H069
  ENST ID: ENST00000399182
  CDS Start-End: 167-1540
tgctgcgtggaaccgccgagttcccagcgcttgagaaggaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgatgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacaaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcgatgcgctcatgacgctggagatgcagctggtggagcagctggaggagactataaacatgtttgaaaggaacattgttgacatggtaggactgtttatcgaaaatgtccaaagcctgatggctcagtgccgggacctggagaatcaccaccacgagaagctcctggagatctctatcagcaccctggagaagattgtcgagggcgacctggacgaggacctgcctaacgacctgcgcgcgggtcgtttccaaaagttcaattatgtggaggcttctggcactttctaagagaagcagttacaggtagaggttgaagtctgagatttcccctggaggtcttcttaaccttagagtctgtataatgagtactgtgggggtgttggaaccaccatttctgatcctgcacaatgccatccggtttgcaccagcacatccactgatgaatggtcacaaaatcagcagggtcggcctgaggaacctggctccatccctggggtctgcacgctaagaaggctctcccggatgtctgcgctgggtcccgcggcagcatgtctatgtctctggaaggagtgtgggcatcaagggcccagacagagatactatgttgtcagggcccagacagagatactatgttgtcagggcctgctttagtgcatgcatcattcactcca

SEQ ID NO: 128448 - DNA, 2008 bp, Homo sapiens
  Payload ID: 5143
  Gene Symbol: DRC3
  Gene Name: dynein regulatory complex subunit 3
  Uniprot ID: Q9H069
  ENST ID: ENST00000399187
  CDS Start-End: 219-1790
ccttagcaaccaagtcgcggcgcttggttccccagcaaccgggagacgcgtctgctgcgtggaaccgccgagttcccagcgcttgagaaggaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgatgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacaaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcgatgcgctcatgacgctggagatgcagctggtggagcagctggaggagactataaacatgtttgaaaggaacattgttgacatggtaggactgtttatcgaaaatgtccaaagcctgatggctcagtgccgggacctggagaatcaccaccacgagaagctcctggagatctctatcagcaccctggagaagattgtcgagggcgacctggacgaggacctgcctaacgacctgcgcgcgctttttgtcgataaagatacgattgttaatgctgtcggggcatcgcacgacatccacctcctgaagattgacaatcgagaagatgagctggtgaccagaatcaactcttggtgtacacgtttaatagacaggattcacaaggatgagatcatgaggaaccgcaagcgcgtgaaggagatcaatcagtacatcgaccacatgcagagcgaactggacaacctggaatgtggcgacatcctagactagatgaatgtcagccacaggagcttcttcaaaacatagcaccagccccagccaggagaaggaagtgcacacgcctcacccgcacctctagagagttgctgggcatctctcaaccgcgatccccaacaccattcttcccccacccctggaaaaacttccaaaagtagagaaaataaaggactcatttcacatttcccctactcataaaaaaaaaaaaaaaa

SEQ ID NO: 128449 - DNA, 551 bp, Homo sapiens
  Payload ID: 5143
  Gene Symbol: DRC3
  Gene Name: dynein regulatory complex subunit 3
  ENST ID: ENST00000581264
  CDS Start-End: 157-551
cttctgacttccccttagcaaccaagtcgcggcgcttggttccccagcaaccgggagacgcgtctgctgcgtggaaccgccgagttcccagcgcttgagaagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaa

SEQ ID NO: 128450 - DNA, 586 bp, Homo sapiens
  Payload ID: 5143
  Gene Symbol: DRC3
  Gene Name: dynein regulatory complex subunit 3
  ENST ID: ENST00000496293
  CDS Start-End: 1-202
gaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcgttgcctggagcccagaggacgtggttggtacctgtcattagggctgaggctgtgaccatcgatcaatgggcttaagttgtgagctgagggactcaggacagaatcaaggagctcctggatctgagagctctgagctaaggcatccagtcacagccactcacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcga

SEQ ID NO: 128451 - DNA, 1953 bp, Homo sapiens
  Payload ID: 5143
  Gene Symbol: DRC3
  Gene Name: dynein regulatory complex subunit 3
  Uniprot ID: Q9H069
  ENST ID: ENST00000584166
  CDS Start-End: 304-1677
agcaaccaagtcgcggcgcttggttccccagcaaccgggagacgcgtctgctgcgtggaaccgccgagttcccagcgcttgagaagggtcttcctatgttgcccgggctggtcttgaactcctgaactcaagcagtccttccacctcggcctcccaaagagctgggattacaggtgaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgatgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacaaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcgatgcgctcatgacgctggagatgcagctggtggagcagctggaggagactataaacatgtttgaaaggaacattgttgacatggtaggactgtttatcgaaaatgtccaaagcctgatggctcagtgccgggacctggagaatcaccaccacgagaagctcctggagatctctatcagcaccctggagaagattgtcgagggcgacctggacgaggacctgcctaacgacctgcgcgcgggtcgtttccaaaagttcaattatgtggaggcttctggcactttctaagagaagcagttacaggtagaggttgaagtctgagatttcccctggaggtcttcttaaccttagagtctgtataatgagtactgtgggggtgttggaaccaccatttctgatcctgcacaatgccatccggtttgcaccagcacatccactgatgaatggtcacaaaatcagcagggtcggcctgaggaacctggctccatccctggggtctgcacgctaagaaggctctcccggatgtctgcgctgggtcccgcggcagcatgtctatgtctctgg

SEQ ID NO: 128452 - DNA, 878 bp, Homo sapiens
  Payload ID: 5143
  Gene Symbol: DRC3
  Gene Name: dynein regulatory complex subunit 3
  ENST ID: ENST00000583171
  CDS Start-End: 1-234
atcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacagcaagtgtctccctctcagtctcccagccctgtgagacagattcctcaagcccccaggtttcttggaaaaggggcattgaagagtagcttcccctgcccacaactaggagagaaagggcagctccctcttcctaatccctttacctgactctgtcagagtgattccagcagcacccttagtttaagtgccattcgagaggagttggaactgcccaacattgagaagatgatcctagaatgcagtgctgacatcagtgagttgttcgatgcgctcatgacgctggagatgcagctggtggagcagctggaggagactataaacatgtttgaaaggaacattgttgacatggtaggactgtttatcgaaaatgtccaaagcctgatggctcagtgccgggacctggagaatcaccaccacgagaagctcctggagatctctatcagcaccctggagaagattgtcgagggcgacctggacgaggacctgcctaacgacctgcgcgcgctttttgtcgataaagatacgattgttaatgctgtcggggcatcgcacgacatccacctcctgaagattgacaatcgagaagatgagctggtgaccagaatcaactcttggtgtacacgtttaatagacaggattcacaaggatgagatcatgaggaaccgcaagcgcgtgaaggagatcaatcagtacatcgaccacatgcagagcgaactggacaacctggaat

SEQ ID NO: 128453 - DNA, 558 bp, Homo sapiens
  Payload ID: 5143
  Gene Symbol: DRC3
  Gene Name: dynein regulatory complex subunit 3
  ENST ID: ENST00000479684
  CDS Start-End: 404-558
ttagcaaccaagtcgcggcgcttggttccccagcaaccgggagacgcgtctgctgcgtggaaccgccgagttcccagcgcttgagaagggtcttcctatgttgcccgggctggtcttgaactcctgaactcaagcagtccttccacctcggcctcccaaagagctgggattacaggtgtaagccatctcgcccaaccaattttctccttattaattcatggccaatagggactatagttttcagatcctgttgacttcaggttatcatttcccaggaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactt

SEQ ID NO: 128454 - DNA, 490 bp, Homo sapiens
  Payload ID: 5143
  Gene Symbol: DRC3
  Gene Name: dynein regulatory complex subunit 3
  ENST ID: ENST00000585108
  CDS Start-End: 75-490
agcaaccgggagacgcgtctgctgcgtggaaccgccgagttcccagcgcttgagaagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctggg

SEQ ID NO: 128455 - DNA, 573 bp, Homo sapiens
  Payload ID: 5143
  Gene Symbol: DRC3
  Gene Name: dynein regulatory complex subunit 3
  ENST ID: ENST00000579977
  CDS Start-End: 267-573
agcgcttgagaaggtgagacctgggagctgaggctcccggaggacttgcagggacagatagtgcccgacgtaactctttcctgtgacctttttctcggagaacgccggcccggcccttctcatttataaaatgagcacgaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcg

SEQ ID NO: 128456 - DNA, 541 bp, Homo sapiens
  Payload ID: 5143
  Gene Symbol: DRC3
  Gene Name: dynein regulatory complex subunit 3
  ENST ID: ENST00000582416
  CDS Start-End: 291-541
gtgtttcaccacacggagatgtggtcacgtgacttgtcaactttcacccaggatgtctcccttctgacttccccttagcaaccaagtcgcggcgcttggttccccagcaaccgggagacgcgtctgctgcgtggaaccgccgagttcccagcgcttgagaaggaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggagaaaaacagcagatgaacccaaaggggaacaggatgatggccaggaggattcccaggaagacatcctccgcatagacaacctctggcagtt

SEQ ID NO: 128457 - DNA, 429 bp, Homo sapiens
  Payload ID: 5143
  Gene Symbol: DRC3
  Gene Name: dynein regulatory complex subunit 3
  ENST ID: ENST00000579376
  CDS Start-End: 1-172
gatggctcagtgccgggacctggagaatcaccaccacgagaagctcctggagatctctatcagcaccctggagaagattgtcgagggcgacctggacgaggacctgcctaacgacctgcgcgcgggtcgtttccaaaagttcaattatgtggaggcttctggcactttctaagagaagcagttacagcacatccactgatgaatggtcacaaaatcagcagggtcggcctgaggaacctggctccatccctggggtctgcacgctaagaaggctctcccggatgtctgcgctgggtcccgcggcagcatgtctatgtctctggaaggagtgtgggcatcaagggcccagacagagatactatgttgtcagggcccagacagagatactatgttgtcagggcctgctttagtgcatgcatcattcactcc

SEQ ID NO: 128458 - DNA, 2680 bp, Homo sapiens
  Payload ID: 5144
  Gene Symbol: DRC7
  Gene Name: dynein regulatory complex subunit 7
  Uniprot ID: Q8IY82
  ENST ID: ENST00000336825
  CDS Start-End: 55-2484
aggctgtcctcggagggagacattccatctccagacacccagagacgctccagaatggaggtcctgagggagaaggtggaggaggaggaggaggccgagcgggaggaggcggccgagtgggctgaatgggcgaggatggagaaaatgatgaggccagttgaggtgcggaaggaggaaatcaccttaaagcaggagacgctcagagacctggagaagaagctgtcagagatccagatcactgtctcagcggagctcccggcctttaccaaggacactattgacatctccaagctgcccatttcctacaaaaccaacacacccaaggaggaacacctgctgcaggtggcagacaacttctcccgccagtacagccatctgtgcccggaccgcgtgcccctcttcctgcaccccctgaacgagtgtgaagtgcccaagttcgtgagcacaaccctccggcccacactgatgccctaccccgagctctacaactgggacagctgtgcccagtttgtctccgacttcctcaccatggtgcccctgcctgaccctctcaagccgaccatcaagaaggaggaaaaggtgctgcctaagaagtataccatcaaaccccccagggacctgtgcagcaggtttgagcaggagcaagaggtgaagaagcagcaggagatcagagcccaggagaagaagcggctgagggaggaggaggagcgcctcatggaagcggagaaggcaaagccggatgccctgcacggcctgcgggtgcactcctgggtccttgtgctatcggggaagcgcgaggtgcctgagaacttcttcatcgacccattcacaggacatagctacagcacccaggatgagcacttcctgggcatcgaaagcctgtggaaccacaagaactactggatcaacatgcaggattgctggaactgctgcaaggacttgatctttgacctgggtgaccctgtgagatgggagtacatgctcctggggactgataagtctcagctgtccttgactgaagaagacgacagtgggataaacgatgaggatgatgtggaaaatctgggcaaggaggatgaggataagagcttcgacatgccccactcgtgggtggagcagattgagatctccccggaagcatttgagacccgctgcccgaacgggaagaaggtgattcagtacaagagggcaaagctggagaagtgggccccgtacctcaatagcaatggccttgtgagccgcctcaccacctatgaggacttgcagtgtaccaatattttggagataaaggagtggtaccagaaccgggaagacatgctggagctgaaacacataaacaagaccacagacctgaagacagactacttcaagcctggccacccccaggctctgcgcgtgcactcgtacaagtccatgcaacctgagatggaccgtgtcattgagttttatgaaacggcccgtgtggatggcctgatgaagcgggaggagacacccaggacaatgacagagtactatcaaggacgcccagacttcctctcctaccgccatgccagcttcggaccccgagtcaagaagctcactctgagcagtgcagagtcaaacccccggcccattgtgaaaatcacagagcggttcttccgcaacccagcgaagcccgcggaggaggacgtggcagagcgcgtgtttctggtcgcggaggagcgcatccagctgcgctaccactgccgtgaggaccacatcacggcctccaagcgcgagttcctgcggcgcaccgaggtggacagcaaaggcaacaagatcatcatgacgcccgacatgtgcatcagcttcgaggtggagcccatggagcacaccaagaagctgctctaccagtacgaggccatgatgcacctgaagagggaggagaagctgtccagacatcaggtctgggagtcagagctggaggtgctggagattctgaagcttcgagaggaagaggaggcggcgcacacactgaccatctccatctatgacaccaagcggaatgagaagagcaaggaatatcgggaggccatggagcgcatgatgcacgaagagcacctgcggcaggtggagacccagctggactacctggccccattcctggcccagctcccgccaggagagaaactaacatgctggcaggcggtgcgcctcaaggatgagtgcctcagcgacttcaagcagcggctcatcaacaaggccaacctcatccaggcccgctttgagaaggagacccaggagctgcaaaagaagcagcagtggtaccaggagaaccaggtgacgctgacacccgaggatgaagacctgtacctgagttactgctctcaggccatgttccgcatccgcatcctggagcagcgcctcaatcgacacaaggaactggccccactgaagtacctggctctggaggaaaagctctacaaggacccacgcctgggggagctccagaaaatattcgcttgatgtccctcctggggcctcagccagagctgccagagaaaggaaacctcttcccgcagcctggctcctgtgttccctctatccagccaatgcctgtttacacagacacctggcctcactgccagcccacctcccctacagccctgtttgttcctgcttctcatgattttcctgtaaataaacacactcttaatttgcc

SEQ ID NO: 128459 - DNA, 3041 bp, Homo sapiens
  Payload ID: 5144
  Gene Symbol: DRC7
  Gene Name: dynein regulatory complex subunit 7
  Uniprot ID: Q8IY82
  ENST ID: ENST00000360716
  CDS Start-End: 222-2846
caggttgttaccatggagatggctaacagctagagcaggctgtcctcggagggaaccgggtcacatcgcagggccacctctagctgcaagagaatctgggaagctgagcaattcaaaccaggcacactgctgccccccacacaactggggttctgccgtatagaagaggagactggatctttggagacattccatctccagacacccagagacgctccagaatggaggtcctgagggagaaggtggaggaggaggaggaggccgagcgggaggaggcggccgagtgggctgaatgggcgaggatggagaaaatgatgaggccagttgaggtgcggaaggaggaaatcaccttaaagcaggagacgctcagagacctggagaagaagctgtcagagatccagatcactgtctcagcggagctcccggcctttaccaaggacactattgacatctccaagctgcccatttcctacaaaaccaacacacccaaggaggaacacctgctgcaggtggcagacaacttctcccgccagtacagccatctgtgcccggaccgcgtgcccctcttcctgcaccccctgaacgagtgtgaagtgcccaagttcgtgagcacaaccctccggcccacactgatgccctaccccgagctctacaactgggacagctgtgcccagtttgtctccgacttcctcaccatggtgcccctgcctgaccctctcaagccgccctcgcacctgtactcctcgaccactgtgctcaagtaccagaaggggaactgctttgacttcagtacgctgctctgctccatgcttatcggctctggctatgatgcttactgcgtcaacggctacggctcgctggacctgtgccacatggacctgacgcgggaggtgtgcccactcactgtgaagcccaaggagaccatcaagaaggaggaaaaggtgctgcctaagaagtataccatcaaaccccccagggacctgtgcagcaggtttgagcaggagcaagaggtgaagaagcagcaggagatcagagcccaggagaagaagcggctgagggaggaggaggagcgcctcatggaagcggagaaggcaaagccggatgccctgcacggcctgcgggtgcactcctgggtccttgtgctatcggggaagcgcgaggtgcctgagaacttcttcatcgacccattcacaggacatagctacagcacccaggatgagcacttcctgggcatcgaaagcctgtggaaccacaagaactactggatcaacatgcaggattgctggaactgctgcaaggacttgatctttgacctgggtgaccctgtgagatgggagtacatgctcctggggactgataagtctcagctgtccttgactgaagaagacgacagtgggataaacgatgaggatgatgtggaaaatctgggcaaggaggatgaggataagagcttcgacatgccccactcgtgggtggagcagattgagatctccccggaagcatttgagacccgctgcccgaacgggaagaaggtgattcagtacaagagggcaaagctggagaagtgggccccgtacctcaatagcaatggccttgtgagccgcctcaccacctatgaggacttgcagtgtaccaatattttggagataaaggagtggtaccagaaccgggaagacatgctggagctgaaacacataaacaagaccacagacctgaagacagactacttcaagcctggccacccccaggctctgcgcgtgcactcgtacaagtccatgcaacctgagatggaccgtgtcattgagttttatgaaacggcccgtgtggatggcctgatgaagcgggaggagacacccaggacaatgacagagtactatcaaggacgcccagacttcctctcctaccgccatgccagcttcggaccccgagtcaagaagctcactctgagcagtgcagagtcaaacccccggcccattgtgaaaatcacagagcggttcttccgcaacccagcgaagcccgcggaggaggacgtggcagagcgcgtgtttctggtcgcggaggagcgcatccagctgcgctaccactgccgtgaggaccacatcacggcctccaagcgcgagttcctgcggcgcaccgaggtggacagcaaaggcaacaagatcatcatgacgcccgacatgtgcatcagcttcgaggtggagcccatggagcacaccaagaagctgctctaccagtacgaggccatgatgcacctgaagagggaggagaagctgtccagacatcaggtctgggagtcagagctggaggtgctggagattctgaagcttcgagaggaagaggaggcggcgcacacactgaccatctccatctatgacaccaagcggaatgagaagagcaaggaatatcgggaggccatggagcgcatgatgcacgaagagcacctgcggcaggtggagacccagctggactacctggccccattcctggcccagctcccgccaggagagaaactaacatgctggcaggcggtgcgcctcaaggatgagtgcctcagcgacttcaagcagcggctcatcaacaaggccaacctcatccaggcccgctttgagaaggagacccaggagctgcaaaagaagcagcagtggtaccaggagaaccaggtgacgctgacacccgaggatgaagacctgtacctgagttactgctctcaggccatgttccgcatccgcatcctggagcagcgcctcaatcgacacaaggaactggccccactgaagtacctggctctggaggaaaagctctacaaggacccacgcctgggggagctccagaaaatattcgcttgatgtccctcctggggcctcagccagagctgccagagaaaggaaacctcttcccgcagcctggctcctgtgttccctctatccagccaatgcctgtttacacagacacctggcctcactgccagcccacctcccctacagccctgtttgttcctgcttctcatgattttcctgtaaataaacacactcttaatttgc

SEQ ID NO: 128460 - DNA, 2906 bp, Homo sapiens
  Payload ID: 5144
  Gene Symbol: DRC7
  Gene Name: dynein regulatory complex subunit 7
  Uniprot ID: Q8IY82
  ENST ID: ENST00000394337
  CDS Start-End: 85-2709
gttaccatggagatggctaacagctagagcaggctgtcctcggagggagacattccatctccagacacccagagacgctccagaatggaggtcctgagggagaaggtggaggaggaggaggaggccgagcgggaggaggcggccgagtgggctgaatgggcgaggatggagaaaatgatgaggccagttgaggtgcggaaggaggaaatcaccttaaagcaggagacgctcagagacctggagaagaagctgtcagagatccagatcactgtctcagcggagctcccggcctttaccaaggacactattgacatctccaagctgcccatttcctacaaaaccaacacacccaaggaggaacacctgctgcaggtggcagacaacttctcccgccagtacagccatctgtgcccggaccgcgtgcccctcttcctgcaccccctgaacgagtgtgaagtgcccaagttcgtgagcacaaccctccggcccacactgatgccctaccccgagctctacaactgggacagctgtgcccagtttgtctccgacttcctcaccatggtgcccctgcctgaccctctcaagccgccctcgcacctgtactcctcgaccactgtgctcaagtaccagaaggggaactgctttgacttcagtacgctgctctgctccatgcttatcggctctggctatgatgcttactgcgtcaacggctacggctcgctggacctgtgccacatggacctgacgcgggaggtgtgcccactcactgtgaagcccaaggagaccatcaagaaggaggaaaaggtgctgcctaagaagtataccatcaaaccccccagggacctgtgcagcaggtttgagcaggagcaagaggtgaagaagcagcaggagatcagagcccaggagaagaagcggctgagggaggaggaggagcgcctcatggaagcggagaaggcaaagccggatgccctgcacggcctgcgggtgcactcctgggtccttgtgctatcggggaagcgcgaggtgcctgagaacttcttcatcgacccattcacaggacatagctacagcacccaggatgagcacttcctgggcatcgaaagcctgtggaaccacaagaactactggatcaacatgcaggattgctggaactgctgcaaggacttgatctttgacctgggtgaccctgtgagatgggagtacatgctcctggggactgataagtctcagctgtccttgactgaagaagacgacagtgggataaacgatgaggatgatgtggaaaatctgggcaaggaggatgaggataagagcttcgacatgccccactcgtgggtggagcagattgagatctccccggaagcatttgagacccgctgcccgaacgggaagaaggtgattcagtacaagagggcaaagctggagaagtgggccccgtacctcaatagcaatggccttgtgagccgcctcaccacctatgaggacttgcagtgtaccaatattttggagataaaggagtggtaccagaaccgggaagacatgctggagctgaaacacataaacaagaccacagacctgaagacagactacttcaagcctggccacccccaggctctgcgcgtgcactcgtacaagtccatgcaacctgagatggaccgtgtcattgagttttatgaaacggcccgtgtggatggcctgatgaagcgggaggagacacccaggacaatgacagagtactatcaaggacgcccagacttcctctcctaccgccatgccagcttcggaccccgagtcaagaagctcactctgagcagtgcagagtcaaacccccggcccattgtgaaaatcacagagcggttcttccgcaacccagcgaagcccgcggaggaggacgtggcagagcgcgtgtttctggtcgcggaggagcgcatccagctgcgctaccactgccgtgaggaccacatcacggcctccaagcgcgagttcctgcggcgcaccgaggtggacagcaaaggcaacaagatcatcatgacgcccgacatgtgcatcagcttcgaggtggagcccatggagcacaccaagaagctgctctaccagtacgaggccatgatgcacctgaagagggaggagaagctgtccagacatcaggtctgggagtcagagctggaggtgctggagattctgaagcttcgagaggaagaggaggcggcgcacacactgaccatctccatctatgacaccaagcggaatgagaagagcaaggaatatcgggaggccatggagcgcatgatgcacgaagagcacctgcggcaggtggagacccagctggactacctggccccattcctggcccagctcccgccaggagagaaactaacatgctggcaggcggtgcgcctcaaggatgagtgcctcagcgacttcaagcagcggctcatcaacaaggccaacctcatccaggcccgctttgagaaggagacccaggagctgcaaaagaagcagcagtggtaccaggagaaccaggtgacgctgacacccgaggatgaagacctgtacctgagttactgctctcaggccatgttccgcatccgcatcctggagcagcgcctcaatcgacacaaggaactggccccactgaagtacctggctctggaggaaaagctctacaaggacccacgcctgggggagctccagaaaatattcgcttgatgtccctcctggggcctcagccagagctgccagagaaaggaaacctcttcccgcagcctggctcctgtgttccctctatccagccaatgcctgtttacacagacacctggcctcactgccagcccacctcccctacagccctgtttgttcctgcttctcatgattttcctgtaaataaacacactcttaatttgcca

SEQ ID NO: 128461 - DNA, 499 bp, Homo sapiens
  Payload ID: 5144
  Gene Symbol: DRC7
  Gene Name: dynein regulatory complex subunit 7
  ENST ID: ENST00000564297
  CDS Start-End: 74-286
gatggctaacagctagagcaggctgtcctcggagggagacattccatctccagacacccagagacgctccagaatggaggtcctgagggagaaggtggaggaggaggaggaggccgagcgggaggaggcggccgagtgggctgaatgggcgaggatggagaaaatgatgaggccagttgaggtgcggaaggaggaaatcaccttaaagcaggagacgctcagagacctggagaagaagctgtcagagatccagatcactgtctcagcggagctcccaagttcgtgagcacaaccctccggcccacactgatgccctaccccgagctctacaactgggacagctgtgcccagtttgtctccgacttcctcaccatggtgcccctgcctgaccctctcaagccgccctcgcacctgtactcctcgaccactgtgctcaagtaccagaaggggaactgctttgacttcagtacgctgctctgctccatgcttatcggctctg

SEQ ID NO: 128462 - DNA, 436 bp, Homo sapiens
  Payload ID: 5144
  Gene Symbol: DRC7
  Gene Name: dynein regulatory complex subunit 7
  ENST ID: ENST00000569167
  CDS Start-End: 278-436
aggttgttaccatggagatggctaacagctagagcaggctgtcctcggaggggtgggaggaggagaagggcagagggctccccaatcacttctgcccacatctcattggccagaaccgggtcacatcgcagggccacctctagctgcaagagaatctgggaagctgagcaattcaaaccaggcacactgctgccccccacacaactggggttctgccgtatagaagaggagactggatctttggaagttcgtgagcacaaccctccggcccacactgatgccctaccccgagctctacaactgggacagctgtgcccagtttgtctccgacttcctcaccatggtgcccctgcctgaccctctcaagccgccctcgcacctgtactcctcgaccactgtgctcaagtaccagaaggggaactgctttgacttcagt

SEQ ID NO: 128463 - DNA, 1830 bp, Homo sapiens
  Payload ID: 5144
  Gene Symbol: DRC7
  Gene Name: dynein regulatory complex subunit 7
  ENST ID: ENST00000562250
  CDS Start-End: 1-1283
tcgacatgccccactcgtgggtggagcagattgagatctccccggaagcatttgagacccgctgcccgaacgggaagaaggtgattcagtacaagagggcaaagctggagaagtgggccccgtacctcaatagcaatggccttgtgagccgcctcaccacctatgaggacttgcagtgtaccaatattttggagataaaggagtggtaccagaaccgggaagacatgctggagctgaaacacataaacaagaccacagacctgaagacagactacttcaagcctggccacccccaggctctgcgcgtgcactcgtacaagtccatgcaacctgagatggaccgtgtcattgagttttatgaaacggcccgtgtggatggcctgatgaagcgggaggagacacccaggacaatgacagagtactatcaaggacgcccagacttcctctcctaccgccatgccagcttcggaccccgagtcaagaagctcactctgagcagtgcagagtcaaacccccggcccattgtgaaaatcacagagcggttcttccgcaacccagcgaagcccgcggaggaggacgtggcagagcgcgtgtttctggtcgcggaggagcgcatccagctgcgctaccactgccgtgaggaccacatcacggcctccaagcgcgagttcctgcggcgcaccgaggtggacagcaaaggcaacaagatcatcatgacgcccgacatgtgcatcagcttcgaggtgctggagattctgaagcttcgagaggaagaggaggcggcgcacacactgaccatctccatctatgacaccaagcggaatgagaagagcaaggaatatcgggaggccatggagcgcatgatgcacgaagagcacctgcggcaggtggagacccagctggactacctggccccattcctggcccagctcccgccaggagagaaactaacatgctggcaggcggtgcgcctcaaggatgagtgcctcagcgacttcaagcagcggctcatcaacaaggccaacctcatccaggcccgctttgagaaggagacccaggagctgcaaaagaagcagcagtggtaccaggagaaccaggtgacgctgacacccgaggatgaagacctgtacctgagttactgctctcaggccatgttccgcatccgcatcctggagcagcgcctcaatcgacacaaggaactggccccactgaagtacctggctctggaggaaaagctctacaaggacccacgcctgggggagctccagaaaatattcgcttgatgtccctcctggggcctcagccagagctgccagagaaaggaaacctcttcccgcagcctggctcctgtgttccctctatccagccaatgcctgtttacacagacacctggcctcactgccagcccacctcccctacagccctgtttgttcctgcttctcatgattttcctgtaaataaacacactcttaatttgccatttgtgccttgcgcttcacaagctccagcagcagcctttctcttcttctgttatctatagcctgggaccacccccttcctccccttggcctgtcgtttgcttcctgtccttctctccgttggaatgtcaggtcttcacagcacctctgcagatggtcccacagccatctgcaaacaactggttatatctcaatgtgactagggtggcccacctcaccaagtgggatggggaaggctaagatgcatgccccagaatttgaggactgaatcccagctcctcctcttaccagataccacttacccatctgtggaatggggtagcattgttgcattaaataagacttatggcca

SEQ ID NO: 128464 - DNA, 530 bp, Homo sapiens
  Payload ID: 5144
  Gene Symbol: DRC7
  Gene Name: dynein regulatory complex subunit 7
  ENST ID: ENST00000564132
  CDS Start-End: 1-479
agaagtataccatcaaaccccccagggacctgtgcagcaggtttgagcaggagcaagaggtgaagaagcagcaggagatcagagcccaggagaagaagcggctgagggaggaggaggagcgcctcatggaagcggagaaggcaaagccggatgccctgcacggcctgcgggtgcactcctgggtccttgtgctatcggggaagcgcgaggtgcctgagaacttcttcatcgacccattcacaggacatagctacagcacccaggatgagcacttcctgggcatcgaaagcctgtggaaccacaagaactactggatcaacatgcaggattgctggaactgctgcaaggtgcctagggagggggagctgggtgggtgtggcaggcacagtgcaggtgataggaatagagggaagcaatggcagccagaccttggggagagcgagacaccaggccacgagggctttgaaccttctccatagctgcgtctccatggcccactcccttgcccatgaataaccattctgatacga

SEQ ID NO: 128465 - DNA, 571 bp, Homo sapiens
  Payload ID: 5144
  Gene Symbol: DRC7
  Gene Name: dynein regulatory complex subunit 7
  ENST ID: ENST00000569375
  CDS Start-End: 290-571
agcttcccaggttgttaccatggagatggctaacagctagagcaggctgtcctcggaggggtgggaggaggagaagggcagagggctccccaatcacttctgcccacatctcattggccagaaccgggtcacatcgcagggccacctctagctgcaagagaatctgggaagctgagcaattcaaaccaggcacactgctgccccccacacaactggggttctgccgtatagaagaggagactggatctttggagacattccatctccagacacccagagacgctccagaatggaggtcctgagggagaaggtggaggaggaggaggaggccgagcgggaggaggcggccgagtgggctgaatgggcgaggatggagaaaatgatgaggccagttgaggtgcggaaggaggaaatcaccttaaagcaggagacgctcagagacctggagaagaagctgtcagagatccagatcactgtctcagcggagctcccggcctttaccaaggacactattgacatctccaagctgcccatttcctacaaaaccaacacacccaaggaggaacacctg

SEQ ID NO: 128466 - DNA, 589 bp, Homo sapiens
  Payload ID: 5144
  Gene Symbol: DRC7
  Gene Name: dynein regulatory complex subunit 7
  ENST ID: ENST00000563126
  CDS Start-End: 80-589
catggagatggctaacagctagagcaggctgtcctcggagggagacattccatctccagacacccagagacgctccagaatggaggtcctgagggagaaggtggaggaggaggaggaggccgagcgggaggaggcggccgagtgggctgaatgggcgaggatggagaaaatgatgaggccagttgaggtgcggaaggaggaaatcaccttaaagcaggagacgctcagagacctggagaagaagctgtcagagatccagatcactgtctcagcggagctcccggcctttaccaaggacactattgacatctccaagctgcccatttcctacaaaaccaacacacccaaggaggaacacctgctgcaggtggcagacaacttctcccgccagtacagccatctgtgcccggaccgcgtgcccctcttcctgcaccccctgaacgagtgtgaagtgcccgtaaggctgaagttcgtgagcacaaccctccggcccacactgatgccctaccccgagctctacaactgggacagctgtgcccagtttgtctccgacttcctcaccatggtgcccctgcctgaccctctcaag

SEQ ID NO: 128467 - DNA, 2379 bp, Homo sapiens
  Payload ID: 5145
  Gene Symbol: DNAAF1
  Gene Name: dynein, axonemal, assembly factor 1
  Uniprot ID: Q8NEP3
  ENST ID: ENST00000378553
  CDS Start-End: 125-2302
agggcgccagcggctggcgaagaaggaaagagggtactctctggctgggctggggccgtagcgacgtccgccgcgaacctgggccccccaaagctgcggggcgttcggtgtcgccgaagtaaacatgcaccctgagccctcggagcctgcgacaggtggtgcagcagagctggattgcgcgcaggagcccggcgtggaggagtctgcgggtgaccacgggagcgcaggccgagggggctgcaaggaagaaattaatgatcctaaggaaatatgtgtgggttcttctgacacatcctaccacagccagcagaaacagagtggtgataatgggtcaggtggtcacttcgcacacccaagagaagacagggaagatcggggccccagaatgactaaaagttccctgcaaaaactctgcaagcagcacaagctttatattaccccagcattgaatgatacgctgtatttacactttaaaggttttgatcgcattgagaacctggaagagtacacagggctgcgctgtctctggctgcagagcaatggaatacagaaaatcgaaaacctggaggcccaaactgagttgcgttgcctcttcttgcaaatgaacttgctccgtaaaattgagaacctggaacctctgcagaaactggatgctcttaacctcagcaacaattacatcaagaccattgaaaacctctcctgcctcccagtcctgaacacattgcagatggcccacaatcacctggagaccgtggaggacattcagcatctacaagagtgtttgaggctttgtgtccttgacctttcgcacaacaagctgagtgacccggagatcctgagcattctggaaagcatgcccgatttgcgtgtactgaatttgatgggaaacccggttatcagacagattcctaattacagaaggacagtcactgtacgactaaagcacttaacatacctggatgatagaccagtgtttccaaaggacagagcttgtgcggaggcctgggctaggggagggtacgcagctgaaaaggaggagagacagcagtgggagagcagggagcggaagaagatcacagacagcattgaagccttggccatgatcaagcagcgggcagaggagaggaaaagacagagagagagtcaagagagaggggagatgacatcttcagatgatggtgagaatgtgcccgccagtgcggaaggcaaggaggagcctcccggggacagagaaacaaggcagaagatggagctatttgttaaggaaagctttgaggccaaggacgagctctgcccggaaaagccaagtggagaggagccgcctgtggaggctaaaagagaggatggaggtccagagccagaggggaccctcccagctgagaccctgctactgtcgtcacctgtggaggttaaaggagaggacggagatggagagccagaggggaccctcccagctgaggccccaccacccccgccacctgtggaggttaaaggagaggatggagatcaagagccagaggggaccctcccagctgagaccctgctactgtcaccgcctgtgaaggttaaaggagaggatggagatcgagagccagaggggaccctcccagctgaggccccaccaccaccgcccctgggagctgccagggaagaaccgactccccaggctgtggccactgagggtgtattcgttacagaacttgatggaacgagaacggaagatttagaaaccattagactggagacaaaggagacattctgcattgatgacctacctgacttggaagatgatgatgaaacaggcaaatctctggaagaccagaatatgtgctttccgaagattgaggtcatctcgagcttgagtgatgacagtgaccctgaactggactacacgtcactccctgtgctggaaaacctccccacagacactctgtcaaatatatttgcagtctctaaagacacctcaaaggcggctcgggtgcccttcacagacatctttaaaaaagaagctaagagggacttggaaatccgaaaacaagacaccaagtccccaagacccctgatccaggagctcagcgacgaggacccctctggccagctactgatgccccccacctgccaaagagatgctgcaccactcacttccagtggagacagggacagcgacttccttgcagcctcttctccggtgccgactgagagcgccgccacacccccagagacgtgtgtcggagttgcccagcccagccaagctctgcccacgtgggacctcactgcattcccagcaccgaaagcatcatagttttccccagttatatgtagcataaatggtttaatcataaatgtctcccttaggcatgataaacattttaacaccca

SEQ ID NO: 128468 - DNA, 649 bp, Homo sapiens
  Payload ID: 5145
  Gene Symbol: DNAAF1
  Gene Name: dynein, axonemal, assembly factor 1
  ENST ID: ENST00000569735
  CDS Start-End: 1-573
aatatgtgctttccgaagattgaggtcatctcgagcttgagtgatgacagtgaccctgaactggactacacgtcactccctgtgctggaaaacctccccacagacactctgtcaaatatatttgcagtctctaaagacacctcaaaggcggctcgggtgcccttcacagacatctttaaaaaagaagctaagagggacttggaaatccgaaaacaagacaccaagtccccaagacccctgatccaggagctcagcgacgaggacccctctggccagctactgatgccccccacctgccaaagagatgctgcaccactcacttccagtggagacagggacagcgacttccttgcagcctcttctccggagatggggtttcaccatgttgaccaggctggtctcgaactcctgacctcaggtgatctgtttgcctcggcctcccaaagtgctgggattacagtgccgactgagagcgccgccacacccccagagacgtgtgtcggagttgcccagcccagccaagctctgcccacgtgggacctcactgcattcccagcaccgaaagcatcatagttttccccagttatatgtagcataaatggtttaatcataaatgtctcccttaggcatgataaacattttaacaccc

SEQ ID NO: 128469 - DNA, 1009 bp, Homo sapiens
  Payload ID: 5145
  Gene Symbol: DNAAF1
  Gene Name: dynein, axonemal, assembly factor 1
  ENST ID: ENST00000567918
  CDS Start-End: 132-875
aaagactagggcgccagcggctggcgaagaaggaaagagggtactctctggctgggctggggccgtagcgacgtccgccgcgaacctgggccccccaaagctgcggggcgttcggtgtcgccgaagtaaacatgcaccctgagccctcggagcctgcgacaggtggtgcagcagagctggattgcgcgcaggagcccggcgtggaggagtctgcgggtgaccacgggagcgcaggccgagggggctgcaaggaagaaattaatgatcctaaggaaatatgtgtgggttcttctgacacatcctaccacagccagcagaaacagagtggtgataatgggtcaggtggtcacttcgcacacccaagagaagacagggaagatcggggccccagaatgactaaaagttccctgcaaaaactctgcaagcagcacaagctttatattaccccagcattgaatgatacgctgtatttacactttaaaggttttgatcgcattgagaacctggaagagtacacagggctgcgctgtctctggctgcagagcaatggaatacagaaaatcgaaaacctggaggcccaaactgagttgcgttgcctcttcttgcaaatgaacttgctccgtaaaattgagaacctggaacctctgcagaaactggatgctcttaacctcagcaacaattacatcaagaccattgaaaacctctcctgcctcccagtcctgaacacattgcagatggcccacaatcacctggagaccgtggaggacattcagcatctacaagagtgtttgaggctttgtgtccttgacctttcgcacaacaagctgagtgacccggagatcctgagcattctggaaagcatgcccgatttgtgacagcggggagagctgtaagccgaggaagaagggccgtccatcctgcggcactcagcagagcgtgtactgaatttgatgggaaacccggttatcagacagattcctaattacagaaggacagtcactgtacgact

SEQ ID NO: 128470 - DNA, 1766 bp, Homo sapiens
  Payload ID: 5145
  Gene Symbol: DNAAF1
  Gene Name: dynein, axonemal, assembly factor 1
  Uniprot ID: Q8NEP3
  ENST ID: ENST00000563093
  CDS Start-End: 132-1388
aaagactagggcgccagcggctggcgaagaaggaaagagggtactctctggctgggctggggccgtagcgacgtccgccgcgaacctgggccccccaaagctgcggggcgttcggtgtcgccgaagtaaacatgcaccctgagccctcggagcctgcgacaggtggtgcagcagagctggattgcgcgcaggagcccggcgtggaggagtctgcgggtgaccacgggagcgcaggccgagggggctgcaaggaagaaattaatgatcctaaggaaatatgtgtgggttcttctgacacatcctaccacagccagcagaaacagagtggtgataatgggtcaggtggtcacttcgcacacccaagagaagacagggaagatcggggccccagaatgactaaaagttccctgcaaaaactctgcaagcagcacaagctttatattaccccagcattgaatgatacgctgtatttacactttaaaggttttgatcgcattgagaacctggaagagtacacagggctgcgctgtctctggctgcagagcaatggaatacagaaaatcgaaaacctggaggcccaaactgagttgcgttgcctcttcttgcaaatgaacttgctccgtaaaattgagaacctggaacctctgcagaaactggatgctcttaacctcagcaacaattacatcaagaccattgaaaacctctcctgcctcccagtcctgaacacattgcagatggcccacaatcacctggagaccgtggaggacattcagcatctacaagagtgtttgaggctttgtgtccttgacctttcgcacaacaagctgagtgacccggagatcctgagcattctggaaagcatgcccgatttgcgtgtactgaatttgatgggaaacccggttatcagacagattcctaattacagaaggacagtcactgtacgactaaagcacttaacatacctggatgatagaccagtgtttccaaaggacagagcttgtgcggaggcctgggctaggggagggtacgcagctgaaaaggaggagagacagcagtgggagagcagggagcggaagaagatcacagacagcattgaagccttggccatgatcaagcagcgggcagaggagaggaaaagacagagagagagtcaagagagaggggagatgacatcttcagatgatggtgagaatgtgcccgccagtgcggaaggcaaggaggagcctcccggggacagagaaacaaggcagaagatggagctatttgttaaggaaagctttgaggccaaggacgagctctgcccggaaaagccaagtggagaggagccgcctgtggaggctaaaagagaggatggagaccctgctactgtcaccgcctgtgaaggttaaaggagaggatggagatcgagagccagaggggaccctcccagctgaggccccaccaccaccgcccctgggagctgccagggaagaaccgactccccaggctgtggccactgagggtgtattcgttacagaacttgatggaacgagaacggaagatttagaaaccattagactggagacaaaggagacattctgcattgatgacctacctgacttggaagatgatgatgaaacaggcaaatctctggaagaccaggttaaggtcattagaaaccattttcccacaggcagcttaattccaccttcgttcttgtcgtttaccgtttctctcctaaacttgaaagtaaaatgttccctgtgcataaagcattgaattccccc

SEQ ID NO: 128471 - DNA, 537 bp, Homo sapiens
  Payload ID: 5145
  Gene Symbol: DNAAF1
  Gene Name: dynein, axonemal, assembly factor 1
  ENST ID: ENST00000564928
  CDS Start-End: 1-176
gaaaacaagacaccaagtccccaagacccctgatccaggagctcagcgacgaggacccctctggccagctactgatgccccccacctgccaaagagatgctgcaccactcacttccagtggagacagggacagcgacttccttgcagcctcttctccggctgccaagtgtatttagtccctgaacctggatccaaggcatctccctgtaggaaacatcagaccggggcagagattgacaaagcaacccacaacagcagctgccaacggccgctgtgcccacctcatcagcagctctgcaggggcctcactccaccctcaccaaacacgaggagccagcactcctggcccccattccactggacaggaaggcgtgagaactgagggacctgcctgaggcccccacagctgaggcgcagcggagccctgcctcccagcacagactaaaatcccagcaacacaggcccaccggcacctccagcctgccttgcgggatgatcttcaggcgaatatacaaaatacaaaagaaactactactg

SEQ ID NO: 128472 - DNA, 2963 bp, Homo sapiens
  Payload ID: 5146
  Gene Symbol: DNAAF2
  Gene Name: dynein, axonemal, assembly factor 2
  Uniprot ID: Q9NVR5
  ENST ID: ENST00000298292
  CDS Start-End: 82-2595
cccagaaactctgaggcggatcccccaacccagtgtcagactgatcgcctttggcccgagggcgaggagccacaggacagtatggccaaagcggcggcctcctcgtcgctggaggacttggacctgagcggagaggaggtccagcggctcacctccgccttccaggacccggagttccggcgaatgttctcccagtacgccgaggagctcaccgacccggagaaccggcggcgctacgaggcggagatcaccgcgctagagcgtgagcgcggggtggaagtgcggttcgtgcacccggagcccggccatgtgctgcgcaccagcctggacggggcgcggcgctgctttgtgaatgtctgcagcaacgcgttggtgggcgcgcccagcagccggcccggctccggtggcgaccggggcgcagctcctggcagccactggtccctgccctacagcctggcgcccggccgcgagtacgcggggcgcagcagcagccgctacatggtctacgacgtggtcttccatccagacgcgcttgcgctggcccggcggcacgagggcttccgccagatgctggacgccacggccctggaggccgtcgagaagcagttcggcgtgaagctggaccgcaggaatgccaagaccctgaaggccaagtataaggggaccccagaggctgcggtgctgcgcacgcccctgcccggggtcatccccgcaaggcctgacggggagccgaagggtcctctcccggacttcccctacccttaccagtacccggcagcccccgggccccgggcgccctcccctccggaagcggccttgcagcccgcccccaccgagcctcgctacagcgtggtgcagcgccaccacgtggacctccaggattaccgctgctccagggactcagccccgagccccgtgccccatgagctggtgatcaccatcgaactgccgctgttgcgctcggccgagcaggcggcgctggaggtaacgagaaagctgctgtgcctcgactcgaggaaacctgactaccggctgcggctctcgctcccgtacccagtggacgatggccgcggcaaggcacaattcaacaaggcccggcggcagctggtggttacgctgccagtggtgctgccggccgcgcgccgggagcccgctgtcgccgtcgccgccgccgcgccggaagagtccgcggaccggtccggaactgacggccaggcctgcgcttccgctcgcgagggggaggcgggacccgcgaggagtcgcgcggaggacggaggccacgatacctgcgtggctggggctgcgggctccggggtcaccaccctgggcgacccggaggtggcgcctccgccggccgcagctggagaggagcgtgtccccaagccgggggagcaggacttgagcaggcacgcggggtcaccgccgggcagcgtggaggagccatctcctggaggagaaaactcacctggtggcggaggctccccttgtttgtcctcccggagcctggcgtggggttcttctgcgggaagagagagtgcgcgcggagatagcagtgtggaaacacgcgaggagtcggagggcacgggcggccagcgctcagcctgcgccatgggtggtcccgggaccaagagcggggagcctttgtgtcctccgttactgtgtaatcaggacaaagaaaccttgactctgctcattcaggtgcctcggatccagccgcaaagtcttcaaggagatttgaatcccctctggtacaaattacgcttctccgcacaagacttagtttattccttctttttgcaatttgctccagagaataaattgagtaccacagaacctgtgattagcatttcttcaaacaatgcagtgatagaactggcaaaatctccagagagccatggacattggagagagtggtattatggtgtaaacaacgattctttggaggaaaggttatttgtcaatgaagaaaatgttaatgagtttcttgaagaggtcctgagctctccattcaaacagtctatgtccttgaccccaccattaattgaagttcttcaagttactgataataagattcaaattaatgcaaagttgcaagaatgtagtaactctgatcagctacaaggaaaggaggaaagagtaaatgaagaaagtcatctaactgaaaaggaatatatagaacattgtaacacccctacaactgattctgattcatctatagcagttaaagcactacaaatagatagctttggtttagttacatgctttcaacaagagtctcttgatgtttctcaaatgatacttggaaaatctcagcaacctgagtcaaaaatgcaatctgaatttataaaagaaaaaagtgctacttgttcaaatgaggaaaaagataacttaaacgagtcagtaataactgaagagaaagaaacagatggagatcacctatcttcattactgaacaaaactacggttcacaatatacctggattcgacagcataaaagaaaccaatatgcaggatggtagtgtgcaggtcattaaagatcatgtgaccaattgtgcattcagttttcagaattctttgctatatgatttggattaattctatataattttggacttttaaatattaaggttaaaaaatacctgtatctaaaattgattctgttaactgttgtcttaaaactaaaggtattaaagtataaaattaaaatttgcaattttttttaaaaaattgcaattttgattctcatgggggaaattggagataatttttttttttttgcctctggagtttaaagtttccttatggagataagttttgtgattcctgtaatagatgtgtatgttttctatttgagagttaaaacatttgagagttaaaacatttagttttaatacaacctatgtatatatacttctgtgttaaattttgctttgtcattaataaaatttaaaaatattcactaa

SEQ ID NO: 128473 - DNA, 2819 bp, Homo sapiens
  Payload ID: 5146
  Gene Symbol: DNAAF2
  Gene Name: dynein, axonemal, assembly factor 2
  Uniprot ID: Q9NVR5
  ENST ID: ENST00000406043
  CDS Start-End: 82-2451
cccagaaactctgaggcggatcccccaacccagtgtcagactgatcgcctttggcccgagggcgaggagccacaggacagtatggccaaagcggcggcctcctcgtcgctggaggacttggacctgagcggagaggaggtccagcggctcacctccgccttccaggacccggagttccggcgaatgttctcccagtacgccgaggagctcaccgacccggagaaccggcggcgctacgaggcggagatcaccgcgctagagcgtgagcgcggggtggaagtgcggttcgtgcacccggagcccggccatgtgctgcgcaccagcctggacggggcgcggcgctgctttgtgaatgtctgcagcaacgcgttggtgggcgcgcccagcagccggcccggctccggtggcgaccggggcgcagctcctggcagccactggtccctgccctacagcctggcgcccggccgcgagtacgcggggcgcagcagcagccgctacatggtctacgacgtggtcttccatccagacgcgcttgcgctggcccggcggcacgagggcttccgccagatgctggacgccacggccctggaggccgtcgagaagcagttcggcgtgaagctggaccgcaggaatgccaagaccctgaaggccaagtataaggggaccccagaggctgcggtgctgcgcacgcccctgcccggggtcatccccgcaaggcctgacggggagccgaagggtcctctcccggacttcccctacccttaccagtacccggcagcccccgggccccgggcgccctcccctccggaagcggccttgcagcccgcccccaccgagcctcgctacagcgtggtgcagcgccaccacgtggacctccaggattaccgctgctccagggactcagccccgagccccgtgccccatgagctggtgatcaccatcgaactgccgctgttgcgctcggccgagcaggcggcgctggaggtaacgagaaagctgctgtgcctcgactcgaggaaacctgactaccggctgcggctctcgctcccgtacccagtggacgatggccgcggcaaggcacaattcaacaaggcccggcggcagctggtggttacgctgccagtggtgctgccggccgcgcgccgggagcccgctgtcgccgtcgccgccgccgcgccggaagagtccgcggaccggtccggaactgacggccaggcctgcgcttccgctcgcgagggggaggcgggacccgcgaggagtcgcgcggaggacggaggccacgatacctgcgtggctggggctgcgggctccggggtcaccaccctgggcgacccggaggtggcgcctccgccggccgcagctggagaggagcgtgtccccaagccgggggagcaggacttgagcaggcacgcggggtcaccgccgggcagcgtggaggagccatctcctggaggagaaaactcacctggtggcggaggctccccttgtttgtcctcccggagcctggcgtggggttcttctgcgggaagagagagtgcgcgcggagatagcagtgtggaaacacgcgaggagtcggagggcacgggcggccagcgctcagcctgcgccatgggtggtcccgggaccaagagcggggagcctttgtgtcctccgttactgtgtaatcaggacaaagaaaccttgactctgctcattcaggtgcctcggatccagccgcaaagtcttcaaggagatttgaatcccctctggtacaaattacgcttctccgcacaagacttagtttattccttctttttgcaatttgctccagagaataaattgagtaccacagaacctgtgattagcatttcttcaaacaatgcagtgatagaactggcaaaatctccagagagccatggacattggagagagtggtattatggtgtaaacaacgattctttggagttgcaagaatgtagtaactctgatcagctacaaggaaaggaggaaagagtaaatgaagaaagtcatctaactgaaaaggaatatatagaacattgtaacacccctacaactgattctgattcatctatagcagttaaagcactacaaatagatagctttggtttagttacatgctttcaacaagagtctcttgatgtttctcaaatgatacttggaaaatctcagcaacctgagtcaaaaatgcaatctgaatttataaaagaaaaaagtgctacttgttcaaatgaggaaaaagataacttaaacgagtcagtaataactgaagagaaagaaacagatggagatcacctatcttcattactgaacaaaactacggttcacaatatacctggattcgacagcataaaagaaaccaatatgcaggatggtagtgtgcaggtcattaaagatcatgtgaccaattgtgcattcagttttcagaattctttgctatatgatttggattaattctatataattttggacttttaaatattaaggttaaaaaatacctgtatctaaaattgattctgttaactgttgtcttaaaactaaaggtattaaagtataaaattaaaatttgcaattttttttaaaaaattgcaattttgattctcatgggggaaattggagataatttttttttttttgcctctggagtttaaagtttccttatggagataagttttgtgattcctgtaatagatgtgtatgttttctatttgagagttaaaacatttgagagttaaaacatttagttttaatacaacctatgtatatatacttctgtgttaaattttgctttgtcattaataaaatttaaaaatattcactaa

SEQ ID NO: 128474 - DNA, 2169 bp, Homo sapiens
  Payload ID: 5147
  Gene Symbol: DNAAF3
  Gene Name: dynein, axonemal, assembly factor 3
  ENST ID: ENST00000391720
  CDS Start-End: 4-1770
cacatgcttccattgcttgattcctcgaaaagggcggggactctgggcagcggttgtggagtgccgcgggtccacagtgctgcactgagcagagaggaaggggcgtcccgggatatttggaggataaaggtgtgggcaagggtgatgaccacacctgccggctccggcagcggcttcggctccgtgtcctggtggggcctgtccccggcgctggacctgcaggctgaaagtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcacccccaggagttccgacgctggcgggacacaggcgtcgcctttgaactcagggactccagcgcctatcatgtgcccaaccggaccctggcgtccggtcgcctcctgagctaccgtggggagcgcgtggcagcgcgcgggtactggggggacatcgccacggggcccttcgtggccttcggcatcgaagcggacgacgagagcctcctgcggacgagcaacggccagccagtcaagacggccggggagatcactcaacacaacgtgacggagctgctccgcgacgtggccgcctgggggcgcgcgagagccaccgggggggacctggaggagcagcagcacgcggagggaagcccggagccagggactccagcagccccgaccccggaatctttcaccgtccacttcctgccgctcaattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccaccct

SEQ ID NO: 128475 - DNA, 2318 bp, Homo sapiens
  Payload ID: 5147
  Gene Symbol: DNAAF3
  Gene Name: dynein, axonemal, assembly factor 3
  ENST ID: ENST00000455045
  CDS Start-End: 454-1917
attggccaaaagtttgtagagggcgggcctcgctcactctcattggtcagttgctcgctgtggtcccatcccacatgcttccattgcttgattcctcgaaaagggcggggactctgggcagcggttgtggagtgccgcgggtccacagtgctgcactgagcagagaggaaggggcgtcccgggatatttggaggataaaggtgtgggcaagggtgatgaccacacctgccggctccggcagcggcttcggctccgtgtcctggtggggcctgtccccggcgctggacctgcaggctgaaagtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacgtgagctgggatgaagatgagagcccagattcccgagtccttgagggaggaagggattgaaattctaaaacctcagttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcacccccaggagttccgacgctggcgggacacaggcgtcgcctttgaactcagggactccagcgcctatcatgtgcccaaccggaccctggcgtccggtcgcctcctgagctaccgtggggagcgcgtggcagcgcgcgggtactggggggacatcgccacggggcccttcgtggccttcggcatcgaagcggacgacgagagcctcctgcggacgagcaacggccagccagtcaagacggccggggagatcactcaacacaacgtgacggagctgctccgcgacgtggccgcctgggggcgcgcgagagccaccgggggggacctggaggagcagcagcacgcggagggaagcccggagccagggactccagcagccccgaccccggaatctttcaccgtccacttcctgccgctcaattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccacccttc

SEQ ID NO: 128476 - DNA, 2059 bp, Homo sapiens
  Payload ID: 5147
  Gene Symbol: DNAAF3
  Gene Name: dynein, axonemal, assembly factor 3
  ENST ID: ENST00000524407
  CDS Start-End: 35-1660
ggggcgtcccgggatatttggaggataaagggtgatgaccacacctgccggctccggcagcggcttcggctccgtgtcctggtggggcctgtccccggcgctggacctgcaggctgaaagtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcacccccaggagttccgacgctggcgggacacaggcgtcgcctttgaactcagggactccagcgcctatcatgtgcccaaccggaccctggcgtccggtcgcctcctgagctaccgtggggagcgcgtggcagcgcgcgggtactggggggacatcgccacggggcccttcgtggccttcggcatcgaagcggacgacgagagcctcctgcggacgagcaacggccagccagtcaagacggccggggagatcactcaacacaacgtgacggagctgctccgcgacgtggccgcctgggggcgcgcgagagccaccgggggggacctggaggagcagcagcacgcggagggaagcccggagccagggactccagcagccccgaccccggaatctttcaccgtccacttcctgccgctcaattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccaccct

SEQ ID NO: 128477 - DNA, 537 bp, Homo sapiens
  Payload ID: 5147
  Gene Symbol: DNAAF3
  Gene Name: dynein, axonemal, assembly factor 3
  ENST ID: ENST00000534170
  CDS Start-End: 201-537
agtgctgcactgagcagagaggaaggggcgtcccgggatatttggaggataaaggtgtgggcaagggtgatgaccacacctgccggctccggcagcggcttcggctccgtgtcctggtggggcctgtccccggcgctggacctgcaggctgaaatccattttttataggggatgctacggtggacgctctgccaaccaccatggtgccccagccagctgtcatcttgccaggtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgc

SEQ ID NO: 128478 - DNA, 570 bp, Homo sapiens
  Payload ID: 5147
  Gene Symbol: DNAAF3
  Gene Name: dynein, axonemal, assembly factor 3
  ENST ID: ENST00000532817
  CDS Start-End: 254-570
attgcttgattcctcgaaaagggcggggactctgggcagcggttgtggagtgccgcgggtccacagtgctgcactgagcagagaggaaggggcgtcccgggatatttggaggataaagggtgatgaccacacctgccggctccggcagcggcttcggctccgtgtcctggtggggcctgtccccggcgctggacctgcaggctgaaatccattttttataggggatgctacggtggacgctctgccaaccaccatggtgccccagccagctgtcatcttgccaggtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgccc

SEQ ID NO: 128479 - DNA, 485 bp, Homo sapiens
  Payload ID: 5147
  Gene Symbol: DNAAF3
  Gene Name: dynein, axonemal, assembly factor 3
  Uniprot ID: Q8N9W5
  ENST ID: ENST00000534214
  CDS Start-End: 59-346
agtgctgcactgagcagagaggaaggggcgtcccgggatatttggaggataaagggtgatgaccacacctgccggctccggcagcggcttcggctccgtgtcctggtggggcctgtccccggcgctggacctgcaggctgaaagtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacgtgagctgggatgaagatgagagcccagattcccgagtccttgagggaggaagggattgaaattctaaaacctcagttctttgtgctggagaataatctggaagctgtggcccgacacatgctgatcttcagcctagccctggaggaaccggagaagatggggctgcaagagcgaagcgagaccttcctggaagtgtgg

SEQ ID NO: 128480 - DNA, 2215 bp, Homo sapiens
  Payload ID: 5147
  Gene Symbol: DNAAF3
  Gene Name: dynein, axonemal, assembly factor 3
  Uniprot ID: Q8N9W5
  ENST ID: ENST00000528412
  CDS Start-End: 115-402
agggcggggactctgggcagcggttgtggagtgccgcgggtccacagtgctgcactgagcagagaggaaggggcgtcccgggatatttggaggataaaggtgtgggcaagggtgatgaccacacctgccggctccggcagcggcttcggctccgtgtcctggtggggcctgtccccggcgctggacctgcaggctgaaagtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacgtgagctgggatgaagatgagagcccagattcccgagtccttgagggaggaagggattgaaattctaaaacctcagttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcacccccaggagttccgacgctggcgggacacaggcgtcgcctttgaactcagggactccagcgcctatcatgtgcccaaccggaccctggcgtccggtcgcctcctgagctaccgtggggagcgcgtggcagcgcgcgggtactggggggacatcgccacggggcccttcgtggccttcggcatcgaagcggacgacgagagcctcctgcggacgagcaacggccagccagtcaagacggccggggagatcactcaacacaacgtgacggagctgctccgcgacgtggccgcctgggggcgcgcgagagccaccgggggggacctggaggagcagcagcacgcggagggaagcccggagccagggactccagcagccccgaccccggaatctttcaccgtccacttcctgccgctcaattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccaccct

SEQ ID NO: 128481 - DNA, 2228 bp, Homo sapiens
  Payload ID: 5147
  Gene Symbol: DNAAF3
  Gene Name: dynein, axonemal, assembly factor 3
  ENST ID: ENST00000527223
  CDS Start-End: 3-1829
acatgcttccattgcttgattcctcgaaaagggcggggactctgggcagcggttgtggagtgccgcgggtccacagtgctgcactgagcagagaggaaggggcgtcccgggatatttggaggataaaggtgtgggcaagggtgatgaccacacctgccggctccggcagcggcttcggctccgtgtcctggtggggcctgtccccggcgctggacctgcaggctgaaagggatgctacggtggacgctctgccaaccaccatggtgccccagccagctgtcatcttgccaggtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcacccccaggagttccgacgctggcgggacacaggcgtcgcctttgaactcagggactccagcgcctatcatgtgcccaaccggaccctggcgtccggtcgcctcctgagctaccgtggggagcgcgtggcagcgcgcgggtactggggggacatcgccacggggcccttcgtggccttcggcatcgaagcggacgacgagagcctcctgcggacgagcaacggccagccagtcaagacggccggggagatcactcaacacaacgtgacggagctgctccgcgacgtggccgcctgggggcgcgcgagagccaccgggggggacctggaggagcagcagcacgcggagggaagcccggagccagggactccagccccgaccccggaatctttcaccgtccacttcctgccgctcaattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccaccct

SEQ ID NO: 128482 - DNA, 893 bp, Homo sapiens
  Payload ID: 5147
  Gene Symbol: DNAAF3
  Gene Name: dynein, axonemal, assembly factor 3
  ENST ID: ENST00000588076
  CDS Start-End: 1-625
cctggaggagcagcagcacgcggagggaagcccggagccagggactccagccccgaccccggaatctttcaccgtccacttcctgccgctcaattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacac

SEQ ID NO: 128483 - DNA, 565 bp, Homo sapiens
  Payload ID: 5147
  Gene Symbol: DNAAF3
  Gene Name: dynein, axonemal, assembly factor 3
  ENST ID: ENST00000526003
  CDS Start-End: 86-565
agtgctgcactgagcagagaggaaggggcgtcccgggatatttggaggataaaggtgtgggcaagaatgtcttttccgcagggtgatgaccacacctgccggctccggcagcggcttcggctccgtgtcctggtggggcctgtccccggcgctggacctgcaggctgaaagtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaag

SEQ ID NO: 128484 - DNA, 3410 bp, Homo sapiens
  Payload ID: 5148
  Gene Symbol: DNAAF5
  Gene Name: dynein, axonemal, assembly factor 5
  Uniprot ID: Q86Y56
  ENST ID: ENST00000297440
  CDS Start-End: 21-2588
tgaccggcgacgcgggcaagatggcggcgctgggggtggcggaggccgtggcggccccacacccggctgagggggccgagacggctgaggcggtggagctgagccgcgccctgagccgcctgctgccggggctggaggccgacagcaagccgggccggcggcgcgccttggaggccctgcggcgcgcgctggaggagccaggccctgccgccgaccccaccgctttccagggcccctgggcgcgcctactgctgccgcgcttgctgcgctgcctgagcgaccccgccgagggctgccgcgcgctggcagtgcacctgctggatctgggcctgcgccgcgccgcgcggccccgcgatgccctgccgcgcctgctgcccgcgctcgccgcgcgcttggccggccccgtgcccgcgcgccgcccgcccgaggcctgtgaggagctgcgcctggcgcttgtgcagctgctgggcctggccgtggacctgtgcggcgccgcgctcgcgccccacctggacgacgctctgcgcgcgctgcgctgctccctgctcgaccccttcgccgccgtgcgccgcgagagctgcagctgcgccgccgccctggcgcaggccacgcccgaccacttccacatgcagtcggagtctctgatcgggcccctgatgcagaccatctcccaccagcactggaaggtccgtgtggccgccattgaagccacaggcgcagtgatccattttggcaacgggaagtccgtggacgacgtgctttcccattttgctcagcgactgtttgatgacgtcccgcaggtccggcgggcggtggcctccgtggtgggcggctggctgctgtgtctgcgtgaccgttactccttcttccacaagctcatccctctgctgctcagtagcctcaacgacgaggtgcctgaggtcaggcagctggctgccagcctctgggaggacgttggcctgcagtggcagaaggagaatgaggaggacctgaaggacaagctggactttgcccctcccaccccaccccattaccctccacatgagcgccgccctgtgctgggctgccgggagctcgtcttcaggaacctctccaagatcctccctgccctgtgccacgacatcaccgactgggtggtggggacccgagtgaagtcggcacagctgctcccagtgctgctgctgcatgccgaggaccacgccacgcagcacctggaggtcgtcctccggaccctgttccaggcctgcaccgacgaggaggcagccgtggtccaaagttgtaccagatccgcagagctcgtcgggacgtttgtcagccctgaggtgtttctgaagctgatcttatcgacgctgaagaagacgccctctgcctccggcctcctggtgctggcctccgccatgcggggttgcccccgagaagccctccagccgcacctggcagccatcgccacagagctggcacaggcccacatctgccaggcatctgaaaacgacctctacctggagcgcctgctgctgtgtgtgcaggctctggtgtctgtgtgtcatgaggactgtggcgtggccagcctgcagctcttggacgtgctgctgacaatagtggccctcgcaggtgctaccggcctgagggacaaggcacaggagacgatggactcactggccatggtggagggtgtcagcagctgccaggacctctaccgcaagcacattggtcccctcctggagcgggtgaccgcgtcgcaccttgactggaccgcacactcgccggagctcctgcagttcagtgtcatcgtcgcacagtcaggccctgccctgggagaagccctgccacacgtcgtgcccacgctgagggcctgtctgcagccctcccaagacccgcagatgcgcctgaagctgttctccatcctgtccaccgtgctgctcagagccacggacaccatcaactcccaggggcagtttcccagctacctcgagacggtgacaaaggacatcctggcccccaatctgcagtggcatgcggggaggacagccgcggccatccgcacggctgccgtgtcctgcctctgggcgctcaccagcagcgaggtcctgtcggcagagcagatacgggacgtgcaggaaacactgatgccccaggtcctgaccaccctggaggaggattcgaagatgacgcgactgatctcatgccgtattatcaacacgttcttaaaaacctcgggcggcatgacggatccagagaaactcatcaggatttatcctgaactcttaaaacgcctagatgacgtgtccaacgatgtgaggatggcagccgcctccaccttggtcacctggctgcagtgtgtcaagggtgccaacgcaaaatcctactatcagagcagtgtccagtacctgtaccgagagttgctggttcaccttgacgatccagagagggccatccaggatgcaattttagaggtcctcaaagagggcagcgggctgttcccagatctcctggtgagggagacggaggccgtcatccacaagcaccgctcggccacctactgcgagcagctcctgcagcatgtgcaggccgtgccagccacacagtgaccacgctggtttcagccacggcacacccttgtccccacctgagccagagtttgtggcctttaaatctcataaacaaggcacctctgtgccagcagtgagactgtgacagcaagaatgtactcctcaggacacctgcccactctttccctggaataacagcctctgagtggattctgcatgttatgtgatttgttctgttcatcgagagggctcccaaacatctgcagctgatttgaaattaaaagtaagtcgcagccgctcctcccgcagccacttcagcagcatcttagattttaagcctcacgtgcgcagctggttcatgaactattggctgcatcctgcttaggtgcccaccaagaaggtttttacctacttaacaaaaaagaaagaagccaaagtgattagaaagaaatgaaatctctttttgggttctgtctactgaaatttaatatctcagtgaacagactaaaaggaatttagaatcctaacaacttatcagatttctcctgttttaaatatactgggactttaaaggttatatgtccggtcaccgtatgttttaagtcggtgttaatgctaacagtgttgaaaacaatatttcatgagatctaattgtggttgcccctataggtagcaggaaagtaaagttgcatttccctctcgcacattctacacccaagtgcctaaaagatctcattgtaagtgggtagtgttaccggaagccattgtgttcacacgggggaaatgccgtatatatttttcaacaaatattaacgtttatactttcatgtttgaaaatttaattaaaaatgtttgttttaa

SEQ ID NO: 128485 - DNA, 1907 bp, Homo sapiens
  Payload ID: 5148
  Gene Symbol: DNAAF5
  Gene Name: dynein, axonemal, assembly factor 5
  ENST ID: ENST00000403952
  CDS Start-End: 674-1516
gaagtgtccgtgcagcgagcaggagctcgcgctgggagggcagacaagtggtccagtggaagtgtccgtgctgcaagcaggagcgctagtgctgggagggcagacacgtggcccaggcggaagtgtccacgcctacctcgagcaggagcgctcatgctgggaaggcagatgggtggcccgggcagaagtgtccgtgctgcaagcaggagcgctcatgctgggaaggcagacacgtggcccaggcgtcaggtttgaacattcttgacagcaagtggctcacccgtcagcgtgcttctttttcccatcccaggagttggacttgacctgtggacatttggctgttttctttttgtttttaagccagaaacactgtcttgtttccagtttaagatgtagagagggtgaaacagtcagaaactgggtcagaagcagcgtggttctcgtggcagggcggcacttggcccaagactcgtgctctggcgggaggctcaagtcaggcgtcccagcagcttcggtgcaacgcctcctgcccggctgcgtggggaggccctccaagacaccagctggtctcaccgcgaggcctgacttcgagccagagcagcgagtacattgcgtctccgtgtggcaagggcaggtgcgggggtctcagtccactaccgagcagcctgctctgatgactggcggcgccagggagaaggctcacatcgcgaggtccccagcaacggctcaaggccctgccctgggagaagccctgccacacgtcgtgcccacgctgagggcctgtctgcagccctcccaagacccgcagatgcgcctgaagctgttctccatcctgtccaccgtgctgctcagagccacggacaccatcaactcccaggggcagtttcccagctacctcgagacggtgacaaaggacatcctggcccccaatctgcagtggcatgcggggaggacagccgcggccatccgcacggctgccgtgtcctgcctctgggcgctcaccagcagcgaggtcctgtcggcagagcagatacgggacgtgcaggaaacactgatgccccaggtcctgaccaccctggaggaggattcgaagatgacgcgactgatctcatgccgtattatcaacacgttcttaaaaacctcgggcggcatgacggatccagagaaactcatcaggatttatcctgaactcttaaaacgcctagatgacgtgtccaacgatgtgaggatggcagccgcctccaccttggtcacctggctgcagtgtgtcaagggtgccaacgcaaaatcctactatcagagcagtgtccagtacctgtaccgagagttgctggttcaccttgacgatccagagagggccatccaggatgcaattttagaggtcctcaaagagggcagcgggctgttcccagatctcctggtgagggagacggaggccgtcatccacaagcaccgctcggccacctactgcgagcagctcctgcagcatgtgcaggccgtgccagccacacagtgaccacgctggtttcagccacggcacacccttgtccccacctgagccagagtttgtggcctttaaatctcataaacaaggcacctctgtgccagcagtgagactgtgacagcaagaatgtactcctcaggacacctgcccactctttccctggaataacagcctctgagtggattctgcatgttatgtgatttgttctgttcatcgagagggctcccaaacatctgcagctgatttgaaattaaaagtaagtcgcagccgctcctcccgcagccacttcagcagcatcttagattttaagcctcacgtgcgcagctggttcatgaactattggctgcatcctgcttaggtgcccaccaagaaggtttttacctacttaacaaaaaagaaagaa

SEQ ID NO: 128486 - DNA, 2350 bp, Homo sapiens
  Payload ID: 5148
  Gene Symbol: DNAAF5
  Gene Name: dynein, axonemal, assembly factor 5
  ENST ID: ENST00000440747
  CDS Start-End: 1-1972
ttcgccgccgtgcgccgcgagagctgcagctgcgccgccgccctggcgcaggccacgcccgcactggaaggtccgtgtggccgccattgaagccacaggcgcagtgatccattttggcaacgggaagtccgtggacgacgtgctttcccattttgctcagcgactgtttgatgacgtcccgcaggtccggcgggcggtggcctccgtggtgggcggctggctgctgtgtctgcgtgaccgttactccttcttccacaagctcatccctctgctgctcagtagcctcaacgacgaggtgcctgaggtcaggcagctggctgccagcctctgggaggacgttggcctgcagtggcagaaggagaatgaggaggacctgaaggacaagctggactttgcccctcccaccccaccccattaccctccacatgagcgccgccctgtgctgggctgccgggagctcgtcttcaggaacctctccaagatcctccctgccctgtgccacgacatcaccgactgggtggtggggacccgagtgaagtcggcacagctgctcccagtgctgctgctgcatgccgaggaccacgccacgcagcacctggaggtcgtcctccggaccctgttccaggcctgcaccgacgaggaggcagccgtggtccaaagttgtaccagatccgcagagctcgtcgggacgtttgtcagccctgaggtgtttctgaagctgatcttatcgacgctgaagaagacgccctctgcctccggcctcctggtgctggcctccgccatgcggggttgcccccgagaagccctccagccgcacctggcagccatcgccacagagctggcacaggcccacatctgccaggcatctgaaaacgacctctacctggagcgcctgctgctgtgtgtgcaggctctggtgtctgtgtgtcatgaggactgtggcgtggccagcctgcagctcttggacgtgctgctgacaatagtggccctcgcaggtgctaccggcctgagggacaaggcacaggagacgatggactcactggccatggtggagggtgtcagcagctgccaggacctctaccgcaagcacattggtcccctcctggagcgggtgaccgcgtcgcaccttgactggaccgcacactcgccggagctcctgcagttcagtgtcatcgtcgcacagtcaggccctgccctgggagaagccctgccacacgtcgtgcccacgctgagggcctgtctgcagccctcccaagacccgcagatgcgcctgaagctgttctccatcctgtccaccgtgctgctcagagccacggacaccatcaactcccaggggcagtttcccagctacctcgagacggtgacaaaggacatcctggcccccaatctgcagtggcatgcggggaggacagccgcggccatccgcacggctgccgtgtcctgcctctgggcgctcaccagcagcgaggtcctgtcggcagagcagatacgggacgtgcaggaaacactgatgccccaggtcctgaccaccctggaggaggattcgaagatgacgcgactgatctcatgccgtattatcaacacgttcttaaaaacctcgggcggcatgacggatccagagaaactcatcaggatttatcctgaactcttaaaacgcctagatgacgtgtccaacgatgtgaggatggcagccgcctccaccttggtcacctggctgcagtgtgtcaagggtgccaacgcaaaatcctactatcagagcagtgtccagtacctgtaccgagagttgctggttcaccttgacgatccagagagggccatccaggatgcaattttagaggtcctcaaagagggcagcgggctgttcccagatctcctggtgagggagacggaggccgtcatccacaagcaccgctcggccacctactgcgagcagctcctgcagcatgtgcaggccgtgccagccacacagtgaccacgctggtttcagccacggcacacccttgtccccacctgagccagagtttgtggcctttaaatctcataaacaaggcacctctgtgccagcagtgagactgtgacagcaagaatgtactcctcaggacacctgcccactctttccctggaataacagcctctgagtggattctgcatgttatgtgatttgttctgttcatcgagagggctcccaaacatctgcagctgatttgaaattaaaagtaagtcgcagccgctcctcccgcagccacttcagcagcatcttagattttaagcctcacgtgcgcagctggttcatgaactattggctgcatcctgcttaggtgcccaccaagaaggtttttacctacttaac

SEQ ID NO: 128487 - DNA, 585 bp, Homo sapiens
  Payload ID: 5148
  Gene Symbol: DNAAF5
  Gene Name: dynein, axonemal, assembly factor 5
  ENST ID: ENST00000437419
  CDS Start-End: 1-585
gctctgcgcgcgctgcgctgctccctgctcgaccccttcgccgccgtgcgccgcgagagctgcagctgcgccgccgccctggcgcaggccacgcccggtccggcgggcggtggcctccgtggtgggcggctggctgctgtgtctgcgtgaccgttactccttcttccacaagctcatccctctgctgctcagtagcctcaacgacgaggtgcctgaggtcaggcagctggctgccagcctctgggaggacgttggcctgcagtggcagaaggagaatgaggaggacctgaaggacaagctggactttgcccctcccaccccaccccattaccctccacatgagcgccgccctgtgctgggctgccgggagctcgtcttcaggaacctctccaagatcctccctgccctgtgccacgacatcaccgactgggtggtggggacccgagtgaagtcggcacagctgctcccagtgctgctgctgcatgccgaggaccacgccacgcagcacctggaggtcgtcctccggaccctgttccaggcctgcaccgacgaggaggcagccgtggtccaaagttgtaccagatc

SEQ ID NO: 128488 - DNA, 13104 bp, Homo sapiens
  Payload ID: 5149
  Gene Symbol: DNAH1
  Gene Name: dynein, axonemal, heavy chain 1
  Uniprot ID: Q9P2D7
  ENST ID: ENST00000420323
  CDS Start-End: 262-13059
ggggggtacccaacctatacgcagacccattgagcagccagactgccctaaacagggctatggagtccttgtcccttctaagagctgtggacaccttgcctccagttcccctcacagtcctttcttccttctgcagtgatcactgagtacctgtgtgaatgccaacaagaaaaataaaaccacagtttggattcaggaaaggttgcaccaccatcaggtcttgaagggagcttcggctggggcatctccctgagaagcagcatggagcagcctaacagtaaaggctatagcctgggaaggacccctcagggcccagagtgcagcagtgctcctgcagtccaagtggggacccacaggggcctagagtataacccggggaagattcttccaggatcagactatgggttgggaaatcctccagcccttgaccccaagctcccacatttacccctgcccccggccccacccacactctcagacttggggcagccacggaagtcacccctgacaggcactgataagaagtacccgctgatgaagcagcgtgggttctactccgacatcctcagccctggaaccttagatcaacttggggaggtatgtcgtggcccccgaatgagccagaacctcctgcggcaggctgaccttgacaagttcaccccaagagtcggaagctttgaggttcctgaagacttccaggagcgcatggagcagcagtgcatcgggtccaccacccggctgctcgcccagactgacttcccactgcaggcctacgagcccaagatgcaggtgcctttccaggtgctgccaggccagcatcctcgcaagattgagatcgagaggaggaaacagcagtacctgagcctggacattgagcagttgctgttcagccagggcatcgactccaacaagctcatgcccaggcacctggaccaccagcacccccaaaccatcgaacagggccatgacccaatcttccccatctacctcccactgaaggtatttgacaatgaggactttgactgccggactcccagagagtggatcaacatgggcttggagccagggtctctggacaggaaacctgtcccgggaaaagccctcttgcccactgatgacttcctggggcatgaggaccccaagagtcagaagctgaagtacaaatggtgcgaggtcggcgtcctggactacgacgaggagaagaagctatacctggtacacaagacagacgagaaaggcctggtgcgagatgagatggggaggcccatcctgaatgcaggggtcaccactgaaggaaggccaccccttcaggtctgtcagtactgggtgccacggatccagcttctcttctgcgctgaggacccttgcatgttcgcacaacgtgtggtccaggccaacgccctgcgcaagaacacggaagcactgctgctctacaacttgtatgtggactgcatgccctctgacggccagcatgtcatcagtgaacagagcctgagcaagatcaagcagtgggccctgagcacgcctcggatgcgcaaaggcccctcggttctagagcacctcagcagtcttgccagagaagtgagcctggactatgagcgcagcatgaacaagatcaactttgaccacgttgtctcttccaagcccgagaccttctcctacgtcaccctccccaagaaggaggaggagcaggtgcctgagcgagggctggtgagtgtccccaagtaccacttctgggagcagaaggaggacttcactttcgtgtccctgctcacacggccagaggtcatcacggccctcagcaaggtgagggccgagtgcaacaaggtgaccgccatgtccctgttccactcgagcctctccaagtacagccacctggaggaatttgagcagatccagtcacagaccttctcccaggtgcagatgttcctcaaggacagctggatcagctcgctaaaggtggccatgcgcagcagcctgcgcgacatgagcaagggctggtacaacctctacgagaccaactgggaggtgtacctcatgtccaagctgcgcaagctgatggagctggtgaagtacatgctgcaggacacactgcgcttcctggtgcaggactcacttgccagcttctcacagttcatcagcgacacctgttgcagcgtgctcaactgcaccgatgacatggtctggggtgacgacttaattaacagcccctacaggccccggaagaatcccctgttcatcatggacctggtgctggacagctctggggtgcactatagcaccccactggagcagtttgaggcatctctgctgaacctcttcgacaagggcatcctggccacccatgccgtgccccagctggagaagctggtgatggaggacatcttcatcagcggtgaccccctgctggagtccgtgggccttcatgagccactggtggaagagctacgggccaccattgccagtgccgtgtccaaggccatgatcccactgcaggcctacgccaaggagtaccgaaagtacctggagctgaacaacaatgacattgcctcctttctcaaaacctaccagacgcagggcctgttggcccaggaggtgcgggaggtagtgctcacccacctgcgggagaaggagatcctggacagctcgctgcccagcagcatcatcattgggcctttctacatcaacaccgacaatgtcaagcagagcctgtccaagaaacgcaaggccctggccacttccgtgctggacatccttgccaagaacctgcataaggaggtggatagcatctgcgaggagttccgcagcatcagccgcaagatctatgagaagcccaacagcattgaggagctggctgagctgcgagagtggatgaagggcatcccggagaggctggtgggcctggaggagcggattgtgaaggtcatggatgactaccaggtcatggatgaattcctctacaacctcagctcagatgacttcaatgacaaatggattgccagcaactggccttctaagatccttgggcagatagagctggtgcagcagcagcatgtggaggatgaggagaagttccgcaaaatccagatcatggatcagaacaacttccaagagaagctggaagggctgcagctggtagtagctggcttctccatccatgtggagatttcacgtgcacacgagatcgccaacgaggtgcggcgtgtcaagaagcagctgaaggactgccagcagctggccatgctctacaacaaccgcgagcgcatcttcagcttgcccatcaccaattatgacaagctctccaggatggtgaaggagttccaaccctacctggacctttggaccacagcgtctgactggctgcgctggtcggagagctggatgaatgaccccctctctgccatcgatgctgagcagctggagaagaacgtggttgaagccttcaagaccatgcacaagtgcgtgaagcagtttaaggacatgccagcctgccaggaagtggccttggacatccgggcccgcatcgaggagttcaaaccatacatcccactgatccaggggctgcgcaaccctggcatgcggatccggcactgggagacactgtccaaccagatcaacatcaatgtcaggcccaaggccaacctgacctttgctcgctgcctggagatgaacctgcaggaccatatcgagagcatcagcaaggtggctgaggtggctggcaaggagtacgccatcgagcaggcactggacaagatggagaaggagtggtcgaccatcctgttcaatgtactgccctacaaggcgacagacacctacatcctgaagagcccggacgaggcctcacagctgctggacgaccacatcgtcatgacccagaatatgtcattttcaccctacaagaagccctttgagcagcgcatcaactcctgggagaacaaactgaagctgacccaggaggttctggaggagtggctgaactgtcagcggtcctggctctacctggagcccatctttagctctgaggacatcaaccagcagctgcctgtggagagcaagcgctaccagaccatggagcggatctggaagaagatcatgaagaatgcctacgagaaccgggaggtgatcaatgtgtgttccgacctgagaatgctggacagcctgcgggactgcaacaagattctggacctggtgcagaagggcctcagcgagtatctggagaccaagaggagcgccttccccagattctacttcctgtcagatgatgaactactagagatcttgtcgcagacaaaggaccccacggccgtgcagccacacctgcgcaagtgcttcgagaacatcgctcggctgctattccaggaggacctggagatcacgcacatgtactcagccgagggggaggaggtacagttgtgcttctccatctacccctccagcaacgtggaggactggctgcgggaggtggagcgcagcatgaaggccagtgtgcacgacatcattgagaaggccatcagggcctaccccacgatgcccaggacccagtgggttctgaactggcctggccaggtgaccatcgctgggtgccagacctactggaccatggaggtggcagaggctctggaggccggcaacctcagaagccaactgttcccccagctctgccagcagctcagtgatctggtggcccttgtgcgggggaagctgtcccgcatgcagcgggcagtgctgtcagcgctaatcgtcattgaggtccatgccaaggacgtggtgagcaagctaatccaggagaacgtggtcagcgtgaatgacttccagtggatctcacagctgaggtactactggacaaataatgacctgtatatccgtgctgtgaatgctgagttcatctatggctatgagtacctgggcaacagtgggaggctggtgatcacgcccctcaccgacaggtgctacctgacactgaccggagctctgcacctcaagtttgggggtgccccagctggcccagctggcacaggcaaaactgagaccaccaaagacctgggtaaggccttggccatacagaccgttgtgttcaactgctctgaccagctcgacttcatggccatgggcaagttcttcaagggcctggccagtgctggggcctgggcctgcttcgacgagttcaatcgcatcgacatcgaggtgctgtctgtggtggcgcagcagatcaccaccatccagaaggcgcagcagcagcgggtggaacgcttcatgtttgagggtgtggagatcccactggtgccatcctgcgcagtgtttatcaccatgaacccgggctacgctggccgcacggagctgcctgacaatctgaaggcgctcttccgacccgtggccatgatggttccagattacgccatgatcactgagatctccctctattcctttggctttaatgaggccagtgtgctggctaagaagatcacaaccaccttcaagctgtcttctgagcagctcagctcccaggatcactatgacttcgggatgagagccgtgaaaactgtgatctcggctgctgggaacctcaagcgagaaaaccccagcatgaatgaggagctgatctgcctccgggccatccgtgatgtgaacgtgcccaagttcctgcaggaggacctcaagctcttctctggcatcgtgtccgacctgtttcccaccatcaaggaggaggacacggactacggcatcctggatgaggccatccgcgaggcctgcaggaacagcaacctcaaggatgtggagggcttcctgacaaagtgcatccagctctacgagaccacggtggtacgacacggcctcatgctcgtcgggcccacaggctccggcaagagtacttgttacagagtcctggcagctgccatgacgtcactgaaagggcagccatccatcagtggtggcatgtacgaggctgtcaactactacgtgctcaaccccaagtccatcacgatgggccagctgtacggggagtttgacctcctcacccatgagtggacagacgggatattctcctcgttcatccgggcgggggccatcacctccgacaccaacaagaagtggtacatgttcgatgggccggtggatgccatctggattgagaacatgaacacggtgctggatgacaacaagaagctgtgcctcagctctggggagatcatcaagctcacagaggcaatgaccatgatgttcgaggtgcaagacctggcggtggcttcaccagctacagtctcccgctgtggcatggtgtacctggagcccagcatcctggggctcatgcccttcatcgagtgctggctgaggaagctgcctcccttgctgaagccctatgaggagcatttcaaggccctctttgtcagcttcctggaggaatccatctccttcgttcggtcctcagtgaaggaggtgatcgcctcaaccaactgcaacctgaccatgagcctcctcaagctgctggactgcttcttcaagccctttctgcctagagagggcctcaagaaaataccctctgaaaagctgagtcgcatcgtagagttgatcgagccctggttcatcttctccctgatctggagcgtgggtgccactggggacagcagtggccgcaccagtttcagccactggctaaggctcaagatggagaacgaacagctgactctgcttttcccagaagaggggctggtgttcgattacaggctggaggacgcgggcatcagtggcaccaacgacagtgaggatgaagaggaggaatacaagcaggttgcctgggtgaagtggatggactcctcagctccattcaccatggtaccagacaccaactactgcaacatcattgtgcccaccatggacaccgtgcagatgtcccatttactggacatgctgctcaccaacaagaagcccgtgctgtgcattgggccaacaggcacggggaagacgctcaccatctctgacaagctcctcaagaacctggcactggattacatcagccacttcctcaccttctcagcccgcacttcagccaaccagacccaggacttcattgacagcaagctggacaagaggcggaagggtgtgtttggaccacctctggggcgcaactttatcttcttcatcgatgacctgaacatgccggccctggagacctacggtgcacagccacccatcgagctgttgcgccagtggatggaccacggcggctggtacgaccgcaagatcattggtgccttcaagaacctagtggacatcaactttgtctgtgccatgggccccccgggtggaggcaggaacaccgtcaccccgcggctgatgcgtcacttcaactacctgtctttcgctgagatggacgaggtcagcaagaaacgcatcttctccaccatcctgggcaactggttggatggactccttggagaaaaaagctaccgggagcgtgtgcctggggccccccacattgcccacttcacggagccccttgtggaagccaccatcatggtgtatgcaaccatcacctcccagctgctgcccactccagccaagtcccactacaccttcaacctgagggacctctccaaggtcttccaaggcatgctcatggctgacccggccaaggtcgaggaccaagtgcagctgctgcgactgtggtatcacgagaactgccgcgtgttccgggaccgactggtgaatgaggaggaccgcagctggttcgaccagctcctcaagcgctgcatggagcagtgggaggtgaccttcaacaaggtctgccccttccagcccattctttacggggacttcatgtcaccaggctccgatgtcaagtcctacgagctcatcaccagtgagagtaagatgatgcaggtgatagaggagtacatagaggactacaaccagatcaacacggccaagctgaagctggtcctcttcatggacgccatgagccacatctgtcgcatcagccgcaccctacgccaggcgctgggcaatgcactcctgctgggcgtgggtggcagcggccgcagctccctcacaaggctcgcctcgcacatggccgagtacgagtgcttccagattgaactatccaagaactacggcatgtccgagtggcgagatgatgtgaagaaggtcctgctcaaggcgggcctacagaacctacccatcaccttcctcttctcagacacccagatcaagaacgaatccttcctggaagatatcaacaacgtcctaaactctggtgacattcccaatctgtatactgcggacgagcaggaccagatcgtcagcaccatgcggccctatatccaggagcagggcctacagcccaccaaggccaacctcatggctgcttacacagggcgtgtgcgcagcaacatccacatggtgctgtgcatgagccccatcggagaggtcttccgagctcgtctgaggcagtttccctccctggtcaactgctgtaccatcgactggtttaacgagtggccggcagaagccctgaagtctgtggccaccgtgttcctcaatgagatcccagaactggaatcctcccaggaagaaatccaaggactgatccaggtctgtgtgtacatccaccagtcggtgtccaagaagtgcatcgagtacctggcagagctgacccgccacaactatgtgacccccaagagctacttggagctgcttcatattttctccatcctcatcgggcagaagaaactggagctgaaaactgccaagaaccgcatgaagagcggcctcgacaagctgctgcgcacttctgaggatgtagccaagatgcaggaggacctggagagtatgcaccccctgctggaggaggctgccaaggacaccatgctcaccatggagcagatcaaggtggatacggccatcgccgaggagacccggaattcagtgcagacagaggagatcaaagccaatgagaaggccaagaaggcacaagctattgctgacgatgcccagaaggacctggacgaggcgttgccagccctggatgcggctctggccagcctgcgcaacctcaacaagaacgatgtgaccgaggtacgtgccatgcagcggccacccccgggtgtgaaactggtcatagaagctgtgtgcattatgaaaggcatcaagcccaagaaggtgcctggagaaaagccaggcaccaaggtggatgactactgggagcctggcaaggggctgctgcaggacccgggccacttccttgagagcctcttcaagtttgacaaggacaacattggggatgtggtgatcaaagccatccagccgtacatcgataatgaagagttccagccagccaccattgccaaggtgtccaaggcttgcacctccatctgccagtgggtgcgcgccatgcacaagtaccactttgtggccaaggccgtggagcccaagcggcaagccctgctggaggcccaggatgacctgggggtgacacagaggatcctggatgaggcaaaacagcgccttcgtgaggtggaggacggcatcgccacaatgcaggctaagtaccgggaatgcattaccaagaaggaggagctggagctgaagtgtgagcagtgtgagcagcggctgggccgagctggcaagctcatcaacgggctgtcggatgagaaggtgcgctggcaggagacggtggagaacctgcagtacatgctcaacaacatctccggcgatgtcctggtggccgctggctttgtggcctacctgggccccttcacgggccagtaccgcacggtgctctacgacagctgggtcaagcagctcaggagccacaatgtcccacacacctccgagcccacgctaatcgggacgctggggaaccctgtgaagatccgatcgtggcagatcgctggcctccccaacgacacactgtcagtggagaacggggtcatcaaccagttttcccagcgctggacccacttcattgaccctcagagccaggccaacaaatggatcaagaacatggagaaggacaatgggctggatgtgttcaagttgagtgaccgcgacttcctgcgcagcatggagaacgccatccgctttggcaagccatgtctcctggagaacgtgggcgaggagctagacccagccctggagccagtgctgctcaagcagacgtacaagcagcagggaaacacggtgctgaagctgggggacacggtgatcccctaccatgaggacttcaggatgtacatcaccaccaagctgcccaacccacactacacgcccgagatctccaccaaactcaccctcatcaacttcaccctgtcgcccagtggcctagaggaccagctactgggccaggtagtggcagaggagcgacccgacctggaggaggccaagaaccagctgattatcagtaatgccaagatgcgccaggagctgaaggacattgaggaccagatcctgtaccggctcagctcctccgagggcaaccctgtagatgacatggaactcatcaaggtgctggaagcctccaagatgaaggctgctgagatccaggccaaagtcaggattgcagagcagacggagaaggacatcgacctgacgcgcatggagtacatacccgtggccatccgcacccagatcctcttcttctgtgtgtccgacctggccaacgtggaccccatgtaccagtactcccttgagtggtttctcaacatcttcctctcgggcatcgccaactcagagagagcagacaacctgaagaagcgcatctccaacatcaaccgctacctgacctacagcctctacagcaacgtctgccgcagcctctttgagaagcacaagctgatgtttgccttcctgctgtgtgttcgcatcatgatgaacgagggcaaaatcaaccagagtgagtggcgatacctcctgtctgggggctccatctcgatcatgactgagaatccggcaccggactggctgtcagaccgggcttggcgagacatcctagcactctcgaacctgccaaccttttcctccttctcttccgacttcgtgaagcacctctcagaattccgggtcatcttcgacagccttgagccccaccgggagcctttgcctggcatctgggaccagtacctagaccagttccagaagctgctagtcctccgctgcctgcgtggggacaaggttaccaacgccatgcaggactttgtggccaccaacctggagccacgcttcattgaaccccagacagccaatctgtcagtggtgttcaaagactccaactccaccacacccctcatctttgtgctgtcacccggcacagaccctgctgccgacctctacaagtttgccgaagaaatgaagttctccaaaaagctctctgccatctccctgggccaggggcagggccctcgggcagaagccatgatgcgcagctccatagagaggggcaaatgggtcttcttccagaactgccacctggcaccaagctggatgccagccctagaacgcctcatcgagcacatcaaccccgacaaggtacacagggacttccgcctctggctcaccagcctgcccagcaacaagttcccagtgtccatcctgcagaacggctccaagatgaccattgagccgccacgcggtgtcagggccaacctgctgaagtcctatagtagccttggtgaagacttcctcaactcctgccacaaggtgatggagttcaagtctctgctgctgtctctgtgcttgttccatgggaacgccctggagcgccgtaagtttgggcccctgggcttcaacatcccctatgagttcacggatggagatctgcgcatctgcatcagccagctcaagatgttcctggacgaatatgatgacatcccctacaaggtcctcaagtacacggcaggggagatcaattacgggggccgtgtcactgatgactgggaccggcgctgcatcatgaacatcttggaggacttctacaaccctgacgtgctctcccctgagcacagctacagcgcctcgggcatctaccaccagatcccgcctacctacgacctccacggctacctctcctacatcaagagcctcccactcaatgatatgcctgagatctttggcctgcatgacaatgccaacatcacctttgcccagaacgagacgttcgccctcctgggcaccatcatccagctgcaacccaaatcatcttctgcaggcagccagggccgggaggagatagtggaggacgtcacccaaaacattctgctcaaggtgcctgagcctatcaacttgcaatgggtgatggccaagtacccagtgctgtatgaggaatcaatgaacacagtactagtacaagaggtcattaggtacaatcggctgctgcaggtgatcacacagacactgcaagacctactcaaggcactcaaggggctggtagtgatgtcctctcagctggagctgatggctgccagcctgtacaacaatactgtgcctgagctctggagtgccaaggcctacccatcgctcaagcctctgtcatcatgggtcatggacctgctgcaacgcctggactttctgcaggcctggatccaagatggcatcccagctgtcttctggatcagtggattcttcttcccccaggctttcttaacaggcactctgcagaattttgcccgcaaatttgtcatctccattgacaccatctcctttgatttcaaggtgatgtttgaggcaccatcagagttaacacaaagaccccaagtagggtgctatatccatggattattcctggaaggtgcccgctgggatccagaggccttccagctggctgagtctcagcccaaggagctgtacacagagatggccgttatctggctcttgccaacacccaaccgcaaggcccaggaccaggacttttacctgtgccccatctacaagacactgactcgtgctggaacactatcaaccacaggacactctaccaactatgtcattgctgtggagatccccacccatcagccccagcgacactggataaagcgtggtgtggccctcatctgtgccctggactactagactcagacagaagggctggggccattaaagctgaattttctaagc

SEQ ID NO: 128489 - DNA, 579 bp, Homo sapiens
  Payload ID: 5149
  Gene Symbol: DNAH1
  Gene Name: dynein, axonemal, heavy chain 1
  ENST ID: ENST00000480649
  CDS Start-End: 1-579
ctccggcgatgtcctggtggccgctggctttgtggcctacctgggccccttcacgatcgctggcctccccaacgacacactgtcagtggagaacggggtcatcaaccagttttcccagcgctggacccacttcattgaccctcagagccaggccaacaaatggatcaagaacatggagaaggacaatgggctggatgtgttcaagttgagtgaccgcgacttcctgcgcagcatggagaacgccatccgctttggcaagccatgtctcctggagaacgtgggcgaggagctagacccagccctggagccagtgctgctcaagcagacgtacaagcagcagggaaacacggtgctgaagctgggggacacggtgatcccctaccatgaggacttcaggatgtacatcaccaccaagctgcccaacccacactacacgcccgagatctccaccaaactcaccctcatcaacttcaccctgtcgcccagtggcctagaggaccagctactgggccaggtagtggcagaggagcgacccgacctggaggaggccaagaaccagctgattatcagtaatgccaa

SEQ ID NO: 128490 - DNA, 3408 bp, Homo sapiens
  Payload ID: 5149
  Gene Symbol: DNAH1
  Gene Name: dynein, axonemal, heavy chain 1
  ENST ID: ENST00000490713
  CDS Start-End: 1-2787
aagaaggaggagctggagctgaagtgtgagcagtgtgagcagcggctgggccgagctggcaagctcatcaacgggctgtcggatgagaaggtgcgctggcaggagacggtggagaacctgcagtacatgctcaacaacatctccggcgatgtcctggtggccgctggctttgtggcctacctgggccccttcacgggccagtaccgcacggtgctctacgacagctgggtcaagcagctcaggagccacaatgtcccacacacctccgagcccacgctaatcgggacgctggggaaccctgtgaagatccgatcgtggcagatcgctggcctccccaacgacacactgtcagtggagaacggggtcatcaaccagttttcccagcgctggacccacttcattgaccctcagagccaggccaacaaatggatcaagaacatggagaaggacaatgggctggatgtgttcaagttgagtgaccgcgacttcctgcgcagcatggagaacgccatccgctttggcaagccatgtctcctggagaacgtgggcgaggagctagacccagccctggagccagtgctgctcaagcagacgtacaagcagcagggaaacacggtgctgaagctgggggacacggtgatcccctaccatgaggacttcaggatgtacatcaccaccaagctgcccaacccacactacacgcccgagatctccaccaaactcaccctcatcaacttcaccctgtcgcccagtggcctagaggaccagctactgggccaggtagtggcagaggagcgacccgacctggaggaggccaagaaccagctgattatcagtaatgccaagatgcgccaggagctgaaggacattgaggaccagatcctgtaccggctcagctcctccgagggcaaccctgtagatgacatggaactcatcaaggtgctggaagcctccaagatgaaggctgctgagatccaggccaaagtcaggattgcagagcagacggagaaggacatcgacctgacgcgcatggagtacatacccgtggccatccgcacccagatcctcttcttctgtgtgtccgacctggccaacgtggaccccatgtaccagtactcccttgagtggtttctcaacatcttcctctcgggcatcgccaactcagagagagcagacaacctgaagaagcgcatctccaacatcaaccgctacctgacctacagcctctacagcaacgtctgccgcagcctctttgagaagcacaagctgatgtttgccttcctgctgtgtgttcgcatcatgatgaacgagggcaaaatcaaccagagtgagtggcgatacctcctgtctgggggctccatctcgatcatgactgagaatccggcaccggactggctgtcagaccgggcttggcgagacatcctagcactctcgaacctgccaaccttttcctccttctcttccgacttcgtgaagcacctctcagaattccgggtcatcttcgacagccttgagccccaccgggagcctttgcctggcatctgggaccagtacctagaccagttccagaagctgctagtcctccgctgcctgcgtggggacaaggttaccaacgccatgcaggactttgtggccaccaacctggagccacgcttcattgaaccccagacagccaatctgtcagtggtgttcaaagactccaactccaccacacccctcatctttgtgctgtcacccggcacagaccctgctgccgacctctacaagtttgccgaagaaatgaagttctccaaaaagctctctgccatctccctgggccaggggcagggccctcgggcagaagccatgatgcgcagctccatagagaggggcaaatgggtcttcttccagaactgccacctggcaccaagctggatgccagccctagaacgcctcatcgagcacatcaaccccgacaaggtacacagggacttccgcctctggctcaccagcctgcccagcaacaagttcccagtgtccatcctgcagaacggctccaagatgaccattgagccgccacgcggtgtcagggccaacctgctgaagtcctatagtagccttggtgaagacttcctcaactcctgccacaaggtgatggagttcaagtctctgctgctgtctctgtgcttgttccatgggaacgccctggagcgccgtaagtttgggcccctgggcttcaacatcccctatgagttcacggatggagatctgcgcatctgcatcagccagctcaagatgttcctggacgaatatgatgacatcccctacaaggtcctcaagtacacggcaggggagatcaattacgggggccgtgtcactgatgactgggaccggcgctgcatcatgaacatcttggaggacttctacaaccctgacgtgctctcccctgagcacagctacagcgcctcgggcatctaccaccagatcccgcctacctacgacctccacggctacctctcctacatcaagagcctcccactcaatgatatgcctgagatctttggcctgcatgacaatgccaacatcacctttgcccagaacgagacgttcgccctcctgggcaccatcatccagctgcaacccaaatcatcttctgcaggcagccagggccgggaggaggtacaatcggctgctgcaggtgatcacacagacactgcaagacctactcaaggcactcaaggggctggtagtgatgtcctctcagctggagctgatggctgccagcctgtacaacaatactgtgcctgagctctggagtgccaaggcctacccatcgctcaagcctctgtcatcatgggtcatggacctgctgcaacgcctggactttctgcaggcctggatccaagatggcatcccagctgtcttctggatcagtggattcttcttcccccaggctttcttaacaggcactctgcagaattttgcccgcaaatttgtcatctccattgacaccatctcctttgatttcaaggtgatgtttgaggcaccatcagagttaacacaaagaccccaagtagggtgctatatccatggattattcctggaaggtgcccgctgggatccagaggccttccagctggctgagtctcagcccaaggagctgtacacagagatggccgttatctggctcttgccaacacccaaccgcaaggcccaggaccaggacttttacctgtgccccatctacaagacactgactcgtgctggaacactatcaaccacaggacactctaccaactatgtcattgctgtggagatccccacccatcagccccagcgacactggataaagcgtggtgtggccctcatctgtgccctggactactagactcagacagaagggctggggccattaaagctgaattttct

SEQ ID NO: 128491 - DNA, 14473 bp, Homo sapiens
  Payload ID: 5150
  Gene Symbol: DNAH10
  Gene Name: dynein, axonemal, heavy chain 10
  Uniprot ID: Q8IVF4
  ENST ID: ENST00000409039
  CDS Start-End: 333-13748
cgggcgcggggcactgccgagcttgcagcccccagcgccggcgccgtcggcggggcgagctgcggccgtttccggggcgcccattgctagggccgccgttgccacggacgcccgccctgcgcccggctccctctgcactgcgcggcgccatggacgacctgcgggtgctgtggatgcgcgaccgcgtgtatgcggctttcggcatcaccgacccccagcttttcgaggacctgctcaaccgcgacgacggccagggcgaggacctcatcttgcacttcctcaaccaggcgagcgaggaggaggggccctcggcgctcttcatctaccgcactatggtgccggaggaggtggaggtggagattgatgagatacctgtcctgtctgaagagggagaagaggaagaagagacttattctcaaaaagtggagtccgtggataaagtgcgagctaagcgtgtgtcactgagaaccgaatctctaggccaacctctaaacagagaggatgaagaaatggacaaagagatttcagaaaaactcccttccaaaagaactgcgaagcacatcatggaaaagatgcatctccacatgctctgtacccctcttcccgaggagttcctggaccaaaacgtggtgtttttcctcagaaataccaaagaggcaatctctgaagctaccgacatgaaggaagctatggaaattatgccagaaacactggagtatggaattataaacgctaatgtgctccattttctgaagaatattatatgtcaggtttttttgccagcattgtccttcaatcagcacaggacgagtacaaccgtgggagtcacatctggagaagtctctaattcctctgagcatgaatcagacctgccgcccatgcctggggaggcagtagaatatcacagtattcaattaatacgggatgaatttttaatgaacgtgcagaaatttgcaagtaatattcaaagaaccatgcagcaacttgaaggtgagatcaagttagaaatgccaatcatcagtgtggagggagaggtgtctgacctggcagctgacccggaaaccgttgacatcttggagcagtgtgtgataaactggctgaatcagatatccacagcggttgaggcccaactgaagaagacacctcagggtaaaggccctctggctgaaattgaattctggagggaaagaaatgcaaccttaagtgcgctgcatgaacaaacaaagcttccaatagtcagaaaagtcttggatgtgatcaaggaatccgactccatgcttgtggctaatctgcagccagtgttcaccgagttattcaagttccacacggaggcctcagacaatgtgcgctttctctccaccgtggagcgttatttcaagaacataacgcacgggtctggcttccacgtggtcctggacaccatccccgccatgatgagtgccctgcggatggtgtggatcatctcccgacactacaacaaagacgagaggatgattccgctcatggagcgcatcgcctgggaaatcgctgagagagtctgccgagtggtcaacctgcggactttgttcaaagaaaatcgagcgagtgcccaaagcaaaaccttggaagccaggaacaccctcaggctgtggaaaaaggcctattttgacacccgggccaagatagaggcttcggggagggaagatcggtgggagtttgaccggaagcggctgttcgagaggacggattatatggccaccatctgccaggacctctccgacgttctgcagattttggaggaattttataacatatttggtccagaactaaaggcagtgacgggggaccccaagcgcattgatgatgtcctatgcagagtggacggcctagtcacccccatggaaaacctgacctttgaccccttcagcatcaagtcctcccagttctggaaatatgtgatggatgaattcaagattgaagttctgattgacatcattaataaaatctttgtccagaaccttgaaaatccaccactgtataagaatcaccctccagtagcaggtgcaatatactgggaacgatctctgttctttcggattaagcataccatcctccgatttcaagaggtacaagagatactggacagtgatcgaggacaggaggtcaaacaaaaatatttggaagtaggtaggacaatgaaggagtatgaagacagaaagtatgagcagtggatggaggtgacggagcaggtgctgccagctctcatgaagaagagccttttgaccaagtcttccatcgccacagaggagccttcgactttagaaaggggagctgtttttgcaatcaacttttcaccggctctcagagagattattaatgaaacaaagtacttagagcagctggggttcactgtccctgaattagcaagaaatgttgctctccaggaagacaaattccttaggtacacagctgggatacagcgcatgttggatcattatcacatgctcataggaacgttaaacgatgcggagtctgtgcttctcaaagatcattcccaggaactgctccgagtgtttaggtcgggatataagaggttgaactggaactcactaggtatcggtgactatataactggttgcaaacaggccattgggaaatttgagtctctcgtccaccagattcataagaatgcagatgacatttcttccaggctgacattaatagaggccataaatctctttaaatatccagccgctaaaagtgaggaagaactcccaggcgtgaaggaattttttgaacacattgagcgagaaagggccagcgacgtggaccacatggtccggtggtatcttgccattggaccactgctgaccaaagttgagggcctggtcgtccacaccaacacaggcaaggcccccaagctggcctcctactacaaatactgggaaaagaaaatttatgaggtcctgacaaagctcatcctgaagaacttgcagtcttttaattctttgatccttggaaatgtccctctgttccacactgaaaccattctgacggcacctgagatcatccttcatcccaacacaaatgagatcgacaagatgtgcttccattgtgtccggaattgcgtggagatcaccaagcattttgttcgttggatgaatggcagctgcatagaatgcccacctcagaagggggaggaagaggaagttgttataataaacttttacaatgatatctctctgaaccctcagataattgaacaagctgttatgatcccccaaaatgtccacaggattctgatcaatcttatgaagtatctacaaaaatggaagcggtatcgacctctctggaaattggacaaagctattgtgatggagaaatttgctgccaagaaacctccttgtgtagcatatgatgaaaagttgcagttctattccaagatagcttatgaggttatgcgccaccctctaattaaggatgagcattgcatcagacttcagctcaggcatctggcaaacacagtgcaggaaaatgccaagtcctgggtgatttcgcttggaaaacttctcaatgagtcagcaaaagaggagctctataatctccatgaagagatggagcacctggccaaaaaccttaggaagatccccaatacccttgaagatctcaagtttgtccttgcaacaattgcagaaattagaagtaaatctctagtcatggaactcagatatagggacgtccaggagcgataccgtaccatggcaatgtataacctctttcctcctgatgcagagaaagaactggttgataagattgagagcatatggtccaatctgtttaatgattcagtgaatgtggagcatgctcttggggacataaagagaactttcacagagcttactcgaggcgaaataatgaactacagagttcagatagaggagtttgcaaagcgtttttacagtgaaggccctggttctgttggtgatgatcttgataaaggagtagagcttttaggtgtttatgaaagagagctggcaagacatgaaaagagccgtcaggaactggctaacgctgagaaacttttcgatcttcctattacaatgtacccagagctgctgaaagtgcagaaggaaatgagtgggctgaggatgatttacgagctctatgaaggactaaaggttgcaaaagaagaatggtctcagaccctttggatcaacctgaatgtgcagattctccaggaaggaattgaaggttttctcagggctctcagaaagctacctcggccagtccgtggcttatcagtgacctactacttggaagcaaaaatgaaggcattcaaagactcgattcctttacttcttgacttgaaaaacgaggcactaagagacaggcattggaaagaacttatggaaaaaacgtctgtcttttttgaaatgaccgaaacgttcaccttggaaaatatgtttgctatggaactgcacaaacacacagatgttctcaatgagattgtcacagcagcaatcaaggaggttgccattgagaaggctgtgaaggaaatcctagacacgtgggaaaatatgaaattcactgtagtcaagtattgcaaaggcacacaggagcgaggctacatcctgggttctgttgacgaaattattcagtctcttgatgacaacactttcaacctgcagagcatctcaggaagcagatttgtggggccttttctgcaaactgttcacaaatgggaaaaaacgctttctctaataggggaagtcattgagatttggatgttggttcagagaaaatggatgtatcttgaaagtatttttattggtggagatataagatcacaacttccggaagaggcaaaaaagtttgacaacatcgataaagtatttaaaaggatcatgggtgagaccttaaaagaccccgtgatcaagaggtgctgtgaagccccaaaccgcctcagtgacctacagaacgtcagcgagggcctggagaaatgccagaaaagcctcaacgactacttagattcgaagagaaatgctttcccaaggttcttcttcatttctgacgatgagttgcttagcattctggggagcagcgacccactctgcgtccaggagcacatgatcaagatgtacgacaacatagcatcactgaggtttaatgacggcgatagtggagaaaaactggtgtccgcgatgatttcagcagaaggagaagtcatggagtttcggaagatcttgcgggctgaagggcgcgtggaggactggatgacggcagttttgaatgagatgagaagaactaatagactaattaccaaagaggctatttttagatactgtgaagacagaagcagagtcgactggatgctcctgtaccagggcatggtggtgctggccgctagccaggtgtggtggacctgggaggtggaagacgtcttccacaaagcgcaaaaaggggagaagcaggccatgaagaactatggcaggaaaatgcaccggcagatcgatgagttggtaacgcgcatcaccatgccgctaagcaaaaacgacaggaaaaaatacaacactgttctcatcattgatgtgcatgccagagacatagttgattctttcataagaggcagtatcctggaggcccgagagtttgactgggaaagtcagttgcggttttattgggaccgggagccggatgagctgaacatccgccagtgcacgggaacctttggctacggctacgagtacatgggcctgaacggcaggctggtcatcacgcccctcaccgatcggatttacctgacgctcacccaggcgctgtccatgtatctaggtggggcccccgccggcccagcaggaaccggcaaaaccgagaccaccaaggacctggcgaaagccttgggcttgctctgtgttgtcaccaactgtggcgaaggcatggattacagggccgtggggaagattttctctggcctggcacagtgcggggcttggggctgctttgatgagtttaatcgaatcgatgcttctgtgctctccgtgatctcctcccagatccagacgatccgaaatgctctgatccatcagttaaccacgttccagtttgaagggcaggagatttccctggactcccgcatgggcatcttcatcaccatgaaccccggctacgcaggccgcacggagctgcccgagtcggtgaaggcgctgttcaggcctgtggtcgtgatcgtgcccgacctgcagcagatctgtgagatcatgctcttctctgagggcttcctggaggccaagactctggcgaaaaagatgacggttctgtataagctggcccgggagcagctgtccaagcagtatcactatgattttggactcagagccctgaaatcggtgctggtcatggctggtgagctgaagagaggctcctctgaccttagggaggacgtggtgctgatgagggccttgcgagacatgaacttgcccaaatttgtgtttgaagatgttcctcttttccttggtttgatttcggatctgtttcctgggctggactgccctcgcgtccgctaccctgacttcaacgatgcggtagagcaggtcctggaggagaacggctacgcggtcctacccatccaggtggataaagtggttcaaatgttcgagaccatgttaacccgccacacgacgatggtggtggggcccaccagagggggcaagtccgtcgtcattaacactctgtgtcaggcccagaccaagcttgggctgacgacaaagttgtacatcctgaaccccaaagccgtgagtgtcatagaactctacggcatcctggacccaaccacccgagactggacagatggggtgttgtcaaacatcttcagggaaatcaacaagccaacagacaagaaggagcgaaagtatattttatttgatggtgatgtggatgctctatgggtggaaaacatgaattctgtgatggatgacaacaggttgttgacattggccaacggggaacgcatccggctccaagcacactgtgccctgctctttgaggttggagatttacagtatgcctcccctgcaactgtctctcgatgtggaatggtttatgtggatcctaaaaacttgaaatatcgaccatactggaaaaaatgggttaatcaaataccaaacaaggtggagcaatacaatttgaatagtctctttgagaagtatgtgccctatctcatggatgtgatagtggaaggaattgtggatggaagacaagcagaaaagctgaagacaatagttcctcagacagacctcaatatggtaacccagttagccaagatgttggatgcgttgctagaaggagaaatagaagaccttgacctgctggagtgctacttcctggaggctttgtactgctctctgggagcctccctgcttgaggatggaaggatgaaatttgacgaatatatcaaacgccttgcttctttgtctactgttgacacagaaggagtttgggccaaccctggggaactgccaggtcaacttccaaccttgtatgactttcattttgataacaaacggaatcaatgggtcccatggagtaaattagttccagagtatattcatgcccccgagaggaaattcatcaacatcctggttcacacagtggataccactcggactacctggatattggaacaaatggttaaaattaagcaacctgttatttttgttggtgaatctggcacttctaagacagccactacccagaatttcctcaaaaatctgagtgaagaaactaacattgtgttaatggtcaacttctcctcccgcaccacgtccatggatatccaaagaaatttagaagcaaatgtggaaaagcgaaccaaagatacttacggcccacccatgggaaaacgcctgctggtgttcatggatgacatgaatatgccaagggtggatgaatatggcacgcagcagcccattgccttgctgaagctgctgttggaaaaaggctacttatatgaccgtgggaaggagctgaactgtaaaagcattcgagaccttggctttattgctgcaatgggaaaggctggaggaggccgcaatgaagttgacccaagatttatttcgctattcagtgtcttcaatgtgccatttccttcagaggagtctctgcatttaatttattcctccatcctgaaaggccacacctcgacgtttcatgagagcattgtggctgtgagtggcaagctgacattctgcacgctagcactttacaaaaatattgtgcaagacctacctcccactccgtcaaagttccattacatcttcaaccttcgagatctctcacgggtttttaatggtcttgtcctcactaacccggagcgattccagacggtggcccagatggtgagagtctggaggaatgagtgtctgagagtcttccacgaccggctgatcagtgaaacagacaagcagctggtacaacagcacataggcagcttggttgtggaacattttaaagatgacgtggaggtggtgatgagggatcccatattgtttggagacttccagatggctctgcacgaaggagaaccacgcatttatgaagacatccaggactacgaggcggccaaggctctgttccaggaaattcttgaagagtataatgaaagcaacaccaaaatgaacttggttctcttcgacgatgctctggagcatttaacccgggtgcaccgtatcatccgcatggaccgcggccacgccctgctggtcggggtagggggctcagggaagcagtctctttcgaggctggctgccttcacagccagctgtgaggtgtttgagatcctgctgagccgaggctactcggagaacagtttccgggaagacctgaagagcctctatttgaaacttgggattgagaacaaagcgatgatctttctgttcacggatgcccatgtggctgaggagggcttcctggagctcatcaacaacatgctgacctcaggaattgtacctgcgcttttttctgaagaggagaaagagtctatcctgagtcagattggacaggaagctctgaagcaaggcatggggccggccaaggagtctgtgtggcagtacttcgtgaacaaaagtgcaaataacctgcacattgtcctgggcatgtcgccagtgggggacaccctgaggacctggtgcagaaacttcccaggtatggtaaataacactggtattgactggttcatgccctggcctccccaagccctccatgcggtcgcaaagtcctttctagggtataatccaatgatcccggcagaaaatatagaaaatgtggtgaagcatgttgtcttggttcaccaatccgtggaccactacagccaacagtttctacagaaattgaggcgcagcaactatgtcactcccaagaactaccttgattttattaacacctattcaaaattgctggatgagaaaactcagtgtaatatagctcagtgcaagcgtctggatgggggactggacaagctgaaggaggccaccatccagctggacgagctgaaccagaagctggccgagcagaagatcgtgctggcggagaagtccgccgcctgcgaggccttgctggaggagatcgccgtcaacaccgctgtagccgaggagaagaagaaactggcagaggaaaaggccatggagatagaggagcagaacaaagtcattgccatggagaaggccgaggccgagacgaccctggcagaggtcatgcccatcctggaggccgccaagctggaactgcagaagctggacaagtcggacgtgactgagattaggtcgtttgctaagcccccgaagcaggtgcagacggtctgcgaatgcatcctcatcatgaaagggtacaaagagctgaactggaaaacagccaagggcgtgatgtccgacccgaatttcctgcggtctctgatggagattgattttgattcgattacccagagccaagtgaaaaacatcaaaggcctcttgaagactcttaataccacaactgaagaaatggaagctgtcagcaaagccgggctggggatgctgaaatttgttgaagctgtaatgggctactgtgatgttttcagagaaatcaagcccaaaagagagaaggtggccaggctggagcggaatttttacctcactaaacgggaactggaaaggatccagaatgagttggcagcaattcagaaagagctggaaacattgggtgccaaatatgaggccgccatactggaaaagcagaagctgcaggaagaagccgagatcatggagaggcggctgattgccgcagacaaactcatctcgggtctggggtcagaaaacatcaggtggctgaacgacctggatgagctgatgcaccggcgcgtgaagctgctgggggactgcctgctctgcgcggctttcctcagctacgagggagccttcacctgggagttccgtgacgagatggtcaatcggatttggcaaaatgacatcctggagcgggagatccccctgagccagcctttccggctggaaagcctgctcacggatgatgttgagatcagcagatggggatcccagggccttccccccgatgagctctccgttcagaatggcatcctcaccacccgggccagccgcttccctctgtgtatcgacccccagcagcaggccctcaactggatcaagagaaaagaggagaagaacaatctgcgggtcgcttcctttaatgaccctgacttcctcaagcagctagagatgtccataaagtacgggacccctttcctgttccgcgatgttgatgaatacatcgatcctgtgattgacaacgtcttagaaaaaaatataaaagtctcccaaggacggcagtttattatcctgggagacaaggaagtggactatgattcaaatttcagactgtacctgaacaccaagctggccaatcccagatattccccatccgtgtttgggaaagctatggtgatcaattacactgtcacgctgaagggcctggaggaccagctgctgagcgtgctggtggcttacgagaggcgggagctggaggagcagcgggagcacctcatccaggagaccagcgagaacaagaacctgctcaaggacctggaagattccctccttcgggagctggccacgtccacggggaacatgctggacaatgtggacctggtgcacaccctggaggagaccaaatccaaggcaacagaggtctcagagaaactcaagctggcggagaagacagccttggacatcgacaggctgcgggatggctaccggccagcagccaggaggggggccatcctgttcttcgtcctgtctgagatggccctggtgaactccatgtaccagtactccctgattgccttcttagaggtcttcaggctgtcactgaagaagtcgctgcctgattccatcctcatgaaacgcctgaggaacatcatggacacgctgaccttcagcatctataaccacggctgcacagggctgtttgagaggcacaagctactcttttcttttaatatgaccatcaagatagaacaagcagaagggagagtccctcaagaagaactagatttctttttaaaaggaaacatttccctggagaaaagcaaaagaaaaaagccctgcgcttggttgtctgaccaaggatgggaagatatcattcttttatcagaaatgttttcagacaactttgggcaacttcctgatgatgttgagaataatcagactgtctggcaggagtggtatgacctggattcactggagcagtttcccgtccccttgggttacgataacaacatcacccctttccagaagttgcttattttgcgctgtttccgtgtggatcgggtctatcgggccgtgactgactatgtgactgtaacaatgggagagaagtatgtgcagcccccaatgatcagctttgaagctatttttgagcagagcactccacattcgcccattgtgtttatcctgagtcctggctccgaccctgccactgatcttatgaaattagcagagcgaagtggttttggaggaaatcgcctcaaattccttgcaatgggtcaaggtcaagaaaaggtggccctgcagctgctggagacggcggtggctcgggggcagtggctgatgctgcagaactgccacctcctggtcaagtggctgaaagatctggagaagtccctggagaggatcaccaagccccacccagacttccgcctgtggctcaccacggaccccaccaagggcttccccattgggattctgcagaagtccctaaaggttgtcaccgagccacccaatgggctgaaactcaacatgagggcaacttacttcaagatctctcacgaaatgctggaccagtgcccgcaccctgccttcaagccgctggtctacgtgctggcgttctttcatgctgtggtgcaggagagaaggaagtttgggaagattggctggaacgtgtactatgacttcaatgagtctgacttccaggtctgcatggaaattctgaacacgtacttaacgaaagccttccagcaacgggacccaaggatcccgtggggcagcctcaagtacctaattggagaggtcatgtatggaggacgggccatcgacagctttgatcgccgcatcctgaccatctacatggatgagtacctgggggacttcatttttgatactttccagccattccacttcttccggaacaaggaagtggactacaaaatccctgttggtgatgaaaaggagaaatttgttgaagccatcgaggccctcccgcttgccaacacgccagaagtgtttggtctccaccccaacgctgagattggctattacacgcaggcggctcgagacatgtgggctcacctgctggagctgcagcctcagacaggggaatccagcagtggtatcagccgcgatgattatattggccaagtggccaaagaaatagaaaacaagatgcccaaagtctttgacttggaccaggtgaggaagcgcctcggaacaggactctcccccacttcggtggtgctcctgcaggaactggaacgcttcaacaagcttgtggtccggatgacgaagtctctggctgaacttcaaagggccttggctggagaagttggaatgagcaatgagttagatgatgtggccaggtctctttttatcgggcatatccctaatatctggagaaggcttgctcctgacaccttaaagtcccttggaaactggatggtctacttcctgcggcggttcagccagtacatgttgtgggtgaccgagagcgagcccagcgtgatgtggctctcggggctgcacatccctgagtcctacctcacggcgctggtgcaggccacctgccggaagaacggctggccactggaccgctccaccttgttcacacaagtgaccaagttccaggatgcagatgaagtgaatgagcgggcgggacaaggatgctttgtctcaggactgtacctggaaggtgctgactgggatatagaaaaaggatgtcttatcaagagcaaacccaaggtgctggttgtggacctgccgatcctgaagatcatccccattgaagcccatcgcctcaagctgcagaatactttccggacccccgtctacaccacctccatgagaaggaacgccatgggagtcggcttggtttttgaagctgatctctttaccacgaggcacatttctcactgggtgctgcaaggagtatgcctcaccctgaattctgattaacctttgggtgaagaaaactgcttaatgaattcggagcctggggttgtcagagtgatcgggtctgctgtcatttcttggggcctctcaagaggcaggagggggactgacactgatttttcatttgaaatcagccacttaaatctctttccatacaaattaacctgaatggttttgtttttaatactactttttaaaaggaatttatataatcaaaaagtaaatattggagagtattttaagatgtgtggagttttcttttccttctcagagaaaacacttgattaggcaaaagtgcctggcatacatagcattggcacaagtgagaatcctaatgtaatttccaaaggtgtgttttcgatgatccaggtctgtttcagcagatgctcctttttggcaagaagggctgatgatgtcgggcacagagcagaagtgaccagtcacctggagccacttctcccccttccagaactctctggccctagcttctttggctctgacctgctacggcgactgtgaagttgttgagcttagtgtttagttcctgcatgagcttctacccccagcctgcctgggtctgtgtggggtcaggtaaggacacagaacctccaggaccagtggtcactgggcaccccttccctctgtgcaccatgaggctggcctggagccctggctggccacctggaggtgaggggtggcttcactccatgagggaggagaggggctag

SEQ ID NO: 128492 - DNA, 3890 bp, Homo sapiens
  Payload ID: 5150
  Gene Symbol: DNAH10
  Gene Name: dynein, axonemal, heavy chain 10
  ENST ID: ENST00000497783
  CDS Start-End: 1-1947
cttgaaagtatttttattggtggagatataagatcacaacttccggaagaggcaaaaaagtttgacaacatcgataaagtatttaaaaggatcatgggtgagaccttaaaagaccccgtgatcaagaggtgctgtgaagccccaaaccgcctcagtgacctacagaacgtcagcgagggcctggagaaatgccagaaaagcctcaacgactacttagattcgaagagaaatgctttcccaaggttcttcttcatttctgacgatgagttgcttagcattctggggagcagcgacccactctgcgtccaggagcacatgatcaagatgtacgacaacatagcatcactgaggtttaatgacggcgatagtggagaaaaactggtgtccgcgatgatttcagcagaaggagaagtcatggagtttcggaagatcttgcgggctgaagggcgcgtggaggactggatgacggcagttttgaatgagatgagaagaactaatagactaattaccaaagaggctatttttagatactgtgaagacagaagcagagtcgactggatgctcctgtaccagggcatggtggtgctggccgctagccaggtgtggtggacctgggaggtggaagacgtcttccacaaagcgcaaaaaggggagaagcaggccatgaagaactatggcaggaaaatgcaccggcagatcgatgagttggtaacgcgcatcaccatgccgctaagcaaaaacgacaggaaaaaatacaacactgttctcatcattgatgtgcatgccagagacatagttgattctttcataagaggcagtatcctggaggcccgagagtttgactgggaaagtcagttgcggttttattgggaccgggagccggatgagctgaacatccgccagtgcacgggaacctttggctacggctacgagtacatgggcctgaacggcaggctggtcatcacgcccctcaccgatcggatttacctgacgctcacccaggcgctgtccatgtatctaggtggggcccccgccggcccagcaggaaccggcaaaaccgagaccaccaaggacctggcgaaagccttgggcttgctctgtgttgtcaccaactgtggcgaaggcatggattacagggccgtggggaagattttctctggcctggcacagtgcggggcttggggctgctttgatgagtttaatcgaatcgatgcttctgtgctctccgtgatctcctcccagatccagacgatccgaaatgctctgatccatcagttaaccacgttccagtttgaagggcaggagatttccctggactcccgcatgggcatcttcatcaccatgaaccccggctacgcaggccgcacggagctgcccgagtcggtgaaggcgctgttcaggcctgtggtcgtgatcgtgcccgacctgcagcagatctgtgagatcatgctcttctctgagggcttcctggaggccaagactctggcgaaaaagatgacggttctgtataagctggcccgggagcagctgtccaagcagtatcactatgattttggactcagagccctgaaatcggtgctggtcatggctggtgagctgaagagaggctcctctgaccttagggaggacgtggtgctgatgagggccttgcgagacatgaacttgcccaaatttgtgtttgaagatgttcctcttttccttggtttgatttcggatctgtttcctgggctggactgccctcgcgtccgctaccctgacttcaacgatgcggtagagcaggtcctggaggagaacggctacgcggtcctacccatccaggtggataaagtggttcaaatgttcgagaccatgttaacccgccacacgacgatggtggtggggcccaccagagggggcaagtccgtcgtcattaacactctgtgtcaggcccagaccaacctctcttgatttaggcttgggctgacgacaaagttgtacatcctgaaccccaaagccgtgagtgtcatagaactctacggcatcctggacccaaccacccgagactggacagatggggtgttgtcaaacatcttcagggaaatcaacaagccaacagacaagaaggagcgaaagtatattttatttgatggtgatgtggatgctctatgggtggaaaacatgaattctgtgatggatgacaacaggttgttgacattggccaacggggaacgcatccggctccaagcacactgtgccctgctctttgaggttggagatttacagtatgcctcccctgcaactgtctctcgatgtggaatggtttatgtggatcctaaaaacttgaaatatcgaccatactggaaaaaatgggttaatcaaataccaaacaaggtggagcaatacaatttgaatagtctctttgagaagtatgtgccctatctcatggatgtgatagtggaaggaattgtggatggaagacaagcagaaaagctgaagacaatagttcctcagacagacctcaatatggtaacccagttagccaagatgttggatgcgttgctagaaggagaaatagaagaccttgacctgctggagtgctacttcctggaggctttgtactgctctctgggagcctccctgcttgaggatggaaggatgaaatttgacgaatatatcaaacgccttgcttctttgtctactgttgacacagaaggagtttgggccaaccctggggaactgccaggtcaacttccaaccttgtatgactttcattttgataacaaacggaatcaatgggtcccatggagtaaattagttccagagtatattcatgcccccgagaggaaattcatcaacatcctggacgtttcatgagagcattgtggctgtgagtggcaagctgacattctgcacgctagcactttacaaaaatattgtgcaagacctacctcccactccgtcaaagttccattacatcttcaaccttcgagatctctcacgggtttttaatggtcttgtcctcactaacccggagcgattccagacggtggcccagatggtgagagtctggaggaatgagtgtctgagagtcttccacgaccggctgatcagtgaaacagacaagcagctggtacaacagcacataggcagcttggttgtggaacattttaaagatgacgtggaggtggtgatgagggatcccatattgtttggagacttccagatggctctgcacgaaggagaaccacgcatttatgaagacatccaggactacgaggcggccaaggctctgttccaggaaattcttgaagagtataatgaaagcaacaccaaaatgaacttggttctcttcgacgatgctctggagcatttaacccgggtgcaccgtatcatccgcatggaccgcggccacgccctgctggtcggggtagggggctcagggaagcagtctctttcgaggctggctgccttcacagccagctgtgaggtcagtccacgtaccctcccagaaataggtttacgatgccagtttctgcagttggtagttcgtgtacatattggaacaatccacagcagatcatagcatgatgttttcatagagtatcgaggtgggtgttttggtttgttttattttttcttgtttttggcttgatattactatattttaactgaatagccagagcatctaagtacaggtgttctttggcttaggatagggttacatcctgataaaataatcataagtcaaaaatattgtcagttgaaaatacatttaatatcccaattaacccatcataaagttgaaaaatcctaagtggaaccatcaaagccggggaccatctgtattgctttgtttttaggatggagaatgtcagatcaagttagaaagtcaaatacaagcacatcctgtg

SEQ ID NO: 128493 - DNA, 1003 bp, Homo sapiens
  Payload ID: 5150
  Gene Symbol: DNAH10
  Gene Name: dynein, axonemal, heavy chain 10
  ENST ID: ENST00000540041
  CDS Start-End: 45-1003
cctctttcttctctggctcaccccagcctcctaccagagcacaaatgcctgggcccctgcctggccgcccccacactgcatccatgccctccgggacctctgtctcctgctcttctctcctgcttttccttcctctcctgctttgccttgtctgtgctgttctcttccacttctgtctttccatggcgtggtctgggagactcctgtggctttcactgaccttgcctggcagtgggatgccccggtcgtttgctaagcccccgaagcaggtgcagacggtctgcgaatgcatcctcatcatgaaagggtacaaagagctgaactggaaaacagccaagggcgtgatgtccgacccgaatttcctgcggtctctgatggagattgattttgattcgattacccagagccaagtgaaaaacatcaaaggcctcttgaagactcttaataccacaactgaagaaatggaagctgtcagcaaagccgggctggggatgctgaaatttgttgaagctgtaatgggctactgtgatgttttcagagaaatcaagcccaaaagagagaaggtggccaggctggagcggaatttttacctcactaaacgggaactggaaaggatccagaatgagttggcagcaattcagaaagagctggaaacattgggtgccaaatatgaggccgccatactggaaaagcagaagctgcaggaagaagccgagatcatggagaggcggctgattgccgcagacaaactcatctcgggtctggggtcagaaaacatcaggtggctgaacgacctggatgagctgatgcaccggcgcgtgaagctgctgggggactgcctgctctgcgcggctttcctcagctacgagggagccttcacctgggagttccgtgacgagatggtcaatcggatttggcaaaatgacatcctggagcgggagatccccctgagccagcctttccggctggaaagcctgctcacggatgatgttgagatcagcag

SEQ ID NO: 128494 - DNA, 3484 bp, Homo sapiens
  Payload ID: 5150
  Gene Symbol: DNAH10
  Gene Name: dynein, axonemal, heavy chain 10
  ENST ID: ENST00000614082
  CDS Start-End: 572-3484
ctcggcgctcttcatctaccgcactatggtgccggaggaggtggaggtggagattgatgagatacctgtcctgtctgaagagggagaagaggaagaagagacttattctcaaaaagtggagtccgtggataaagtgcgagctaagcgtgtgtcactgagaaccgaatctctaggccaacctctaaacagagaggatgaagaaatggacaaagagatttcagaaaaactcccttccaaaagaactgcgaagcacatcatggaaaagatgcatctccacatgctctgtacccctcttcccgaggagttcctggaccaaaacgtggtgtttttcctcagaaataccaaagaggcaatctctgaagctaccgacatgaaggaagctatggaaattatgccagaaacactggagtatggaattataaacgctaatgtgctccattttctgaagaatattatatgtcaggtttttttgccagcattgtccttcaatcagcacaggacgagtacaaccgtgggagtcacatctggagaagtctctaattcctctgagcatgaatcagacctgccgcccatgcctggggaggcagtagaatatcacagtattcaattaatacgggatgaatttttaatgaacgtgcagaaatttgcaagtaatattcaaagaaccatgcagcaacttgaaggtgagatcaagttagaaatgccaatcatcagtgtggagggagaggtgtctgacctggcagctgacccggaaaccgttgacatcttggagcagtgtgtgataaactggctgaatcagatatccacagcggttgaggcccaactgaagaagacacctcagggtaaaggccctctggctgaaattgaattctggagggaaagaaatgcaaccttaagtgcgctgcatgaacaaacaaagcttccaatagtcagaaaagtcttggatgtgatcaaggaatccgactccatgcttgtggctaatctgcagccagtgttcaccgagttattcaagttccacacggaggcctcagacaatgtgcgctttctctccaccgtggagcgttatttcaagaacataacgcacgggtctggcttccacgtggtcctggacaccatccccgccatgatgagtgccctgcggatggtgtggatcatctcccgacactacaacaaagacgagaggatgattccgctcatggagcgcatcgcctgggaaatcgctgagagagtctgccgagtggtcaacctgcggactttgttcaaagaaaatcgagcgagtgcccaaagcaaaaccttggaagccaggaacaccctcaggctgtggaaaaaggcctattttgacacccgggccaagatagaggcttcggggagggaagatcggtgggagtttgaccggaagcggctgttcgagaggacggattatatggccaccatctgccaggacctctccgacgttctgcagattttggaggaattttataacatatttggtccagaactaaaggcagtgacgggggaccccaagcgcattgatgatgtcctatgcagagtggacggcctagtcacccccatggaaaacctgacctttgaccccttcagcatcaagtcctcccagttctggaaatatgtgatggatgaattcaagattgaagttctggttattgagaaagaagcaaaacattttattgatgaatcttttaagacgcttcgatctgctgaagcagcatttgacatgcttttaaaatttaagcacattcgttcacgggaggctgttaatcgacaaatgatgatgaaatttaatgatattcttgcacagtactgtaaagagattgacatcattaataaaatctttgtccagaaccttgaaaatccaccactgtataagaatcaccctccagtagcaggtgcaatatactgggaacgatctctgttctttcggattaagcataccatcctccgatttcaagaggtacaagagatactggacagtgatcgaggacaggaggtcaaacaaaaatatttggaagtaggtaggacaatgaaggagtatgaagacagaaagtatgagcagtggatggaggtgacggagcaggtgctgccagctctcatgaagaagagccttttgaccaagtcttccatcgccacagaggagccttcgactttagaaaggggagctgtttttgcaatcaacttttcaccggctctcagagagattattaatgaaacaaagtacttagagcagctggggttcactgtccctgaattagcaagaaatgttgctctccaggaagacaaattccttaggtacacagctgggatacagcgcatgttggatcattatcacatgctcataggaacgttaaacgatgcggagtctgtgcttctcaaagatcattcccaggaactgctccgagtgtttaggtcgggatataagaggttgaactggaactcactaggtatcggtgactatataactggttgcaaacaggccattgggaaatttgagtctctcgtccaccagattcataagaatgcagatgacatttcttccaggctgacattaatagaggccataaatctctttaaatatccagccgctaaaagtgaggaagaactcccaggcgtgaaggaattttttgaacacattgagcgagaaagggccagcgacgtggaccacatggtccggtggtatcttgccattggaccactgctgaccaaagttgagggcctggtcgtccacaccaacacaggcaaggcccccaagctggcctcctactacaaatactgggaaaagaaaatttatgaggtcctgacaaagctcatcctgaagaacttgcagtcttttaattctttgatccttggaaatgtccctctgttccacactgaaaccattctgacggcacctgagatcatccttcatcccaacacaaatgagatcgacaagatgtgcttccattgtgtccggaattgcgtggagatcaccaagcattttgttcgttggatgaatggcagctgcatagaatgcccacctcagaagggggaggaagaggaagttgttataataaacttttacaatgatatctctctgaaccctcagataattgaacaagctgttatgatcccccaaaatgtccacaggattctgatcaatcttatgaagtatctacaaaaatggaagcggtatcgacctctctggaaattggacaaagctattgtgatggagaaatttgctgccaagaaacctccttgtgtagcatatgatgaaaagttgcagttctattccaagatagcttatgaggttatgcgccaccctctaattaaggatgagcattgcatcagacttcagctcaggcatctggcaaacacagtgcaggaaaatgccaagtcctgggtgatttcgcttggaaaacttctcaatgagtcagcaaaagaggagctctataatctccatgaagagatggaggtactcaatcgctgtgtgtaa

SEQ ID NO: 128495 - DNA, 448 bp, Homo sapiens
  Payload ID: 5150
  Gene Symbol: DNAH10
  Gene Name: dynein, axonemal, heavy chain 10
  ENST ID: ENST00000538983
  CDS Start-End: 1-246
gaacgcttcaacaagcttgtggtccggatgacgaagtctctggctgaacttcaaagggccttggctggagaagttggaatgagcaatgagttagatgatgtggccaggtctctttttatcgggcatatccctaatatctggagaaggcttgctcctgacaccttaaagtcccttggaaactggatggtctacttcctgcggcggttcagccagtacatgttgtggctcttgttggatggttcttagaaaggctgaaaccacagtctatgagagtgcttctttcctcactccgctgcaatgctgcgttcttaacattttggatcactgtctccctgataggtgaccgagagcgagcccagcgtgatgtggctctcggggctgcacatccctgagtcctacctcacggcgctggtgcaggccacctgccggaagaacggctggccactgg

SEQ ID NO: 128496 - DNA, 1003 bp, Homo sapiens; identical to SEQ ID NO: 128493
  Payload ID: 5150
  Gene Symbol: DNAH10
  Gene Name: dynein, axonemal, heavy chain 10
  ENST ID: ENST00000631648
  CDS Start-End: 45-1003

SEQ ID NO: 128497 - DNA, 448 bp, Homo sapiens
  Payload ID: 5150
  Gene Symbol: DNAH10
  Gene Name: dynein, axonemal, heavy chain 10
  ENST ID: ENST00000631771
  CDS Start-End: 1-255
gaacgcttcaacaagcttgtggtccggatgacgaagtctctggctgaacttcaaagggccttggctggagaagttggaatgagcaatgagttagatgatgtggccaggtctctttttatcgggcatatccctaatatctggagaaggcttgctcctgacaccttaaagtcccttggaaactggatggtctacttcctgcggcggttcagccagtacatgttgtggctcttgttggatggttcttggaaaggctgaaaccacagtctatgagagtgcttctttcctcactccgctgcaatgctgcgttcttaacattttggatcactgtctccctgataggtgaccgagagcgagcccagcgtgatgtggctctcggggctgcacatccctgagtcctacctcacggcgctggtgcaggccacctgccggaagaacggctggccactgg

SEQ ID NO: 128498 - DNA, 9824 bp, Homo sapiens
  Payload ID: 5150
  Gene Symbol: DNAH10
  Gene Name: dynein, axonemal, heavy chain 10
  ENST ID: ENST00000631855
  CDS Start-End: 1-9591
gttgcaaaagaagaatggtctcagaccctttggatcaacctgaatgtgcagattctccaggaaggaattgaaggttttctcagggctctcagaaagctacctcggccagtccgtggcttatcagtgacctactacttggaagcaaaaatgaaggcattcaaagactcgattcctttacttcttgacttgaaaaacgaggcactaagagacaggcattggaaagaacttatggaaaaaacgtctgtcttttttgaaatgaccgaaacgttcaccttggaaaatatgtttgctatggaactgcacaaacacacagatgttctcaatgagattgtcacagcagcaatcaaggaggttgccattgagaaggctgtgaaggaaatcctagacacgtgggaaaatatgaaattcactgtagtcaagtattgcaaaggcacacaggagcgaggctacatcctgggttctgttgacgaaattattcagtctcttgatgacaacactttcaacctgcagagcatctcaggaagcagatttgtggggccttttctgcaaactgttcacaaatgggaaaaaacgctttctctaataggggaagtcattgagatttggatgttggttcagagaaaatggatgtatcttgaaagtatttttattggtggagatataagatcacaacttccggaagaggcaaaaaagtttgacaacatcgataaagtatttaaaaggatcatgggtgagaccttaaaagaccccgtgatcaagaggtgctgtgaagccccaaaccgcctcagtgacctacagaacgtcagcgagggcctggagaaatgccagaaaagcctcaacgactacttagattcgaagagaaatgctttcccaaggttcttcttcatttctgacgatgagttgcttagcattctggggagcagcgacccactctgcgtccaggagcacatgatcaagatgtacgacaacatagcatcactgaggtttaatgacggcgatagtggagaaaaactggtgtccgcgatgatttcagcagaaggagaagtcatggagtttcggaagatcttgcgggctgaagggcgcgtggaggactggatgacggcagttttgaatgagatgagaagaactaatagactaattaccaaagaggctatttttagatactgtgaagacagaagcagagtcgactggatgctcctgtaccagggcatggtggtgctggccgctagccaggtgtggtggacctgggaggtggaagacgtcttccacaaagcgcaaaaaggggagaagcaggccatgaagaactatggcaggaaaatgcaccggcagatcgatgagttggtaacgcgcatcaccatgccgctaagcaaaaacgacaggaaaaaatacaacactgttctcatcattgatgtgcatgccagagacatagttgattctttcataagaggcagtatcctggaggcccgagagtttgactgggaaagtcagttgcggttttattgggaccgggagccggatgagctgaacatccgccagtgcacgggaacctttggctacggctacgagtacatgggcctgaacggcaggctggtcatcacgcccctcaccgatcggatttacctgacgctcacccaggcgctgtccatgtatctaggtggggcccccgccggcccagcaggaaccggcaaaaccgagaccaccaaggacctggcgaaagccttgggcttgctctgtgttgtcaccaactgtggcgaaggcatggattacagggccgtggggaagattttctctggcctggcacagtgcggggcttggggctgctttgatgagtttaatcgaatcgatgcttctgtgctctccgtgatctcctcccagatccagacgatccgaaatgctctgatccatcagttaaccacgttccagtttgaagggcaggagatttccctggactcccgcatgggcatcttcatcaccatgaaccccggctacgcaggccgcacggagctgcccgagtcggtgaaggcgctgttcaggcctgtggtcgtgatcgtgcccgacctgcagcagatctgtgagatcatgctcttctctgagggcttcctggaggccaagactctggcgaaaaagatgacggttctgtataagctggcccgggagcagctgtccaagcagtatcactatgattttggactcagagccctgaaatcggtgctggtcatggctggtgagctgaagagaggctcctctgaccttagggaggacgtggtgctgatgagggccttgcgagacatgaacttgcccaaatttgtgtttgaagatgttcctcttttccttggtttgatttcggatctgtttcctgggctggactgccctcgcgtccgctaccctgacttcaacgatgcggtagagcaggtcctggaggagaacggctacgcggtcctacccatccaggtggataaagtggttcaaatgttcgagaccatgttaacccgccacacgacgatggtggtggggcccaccagagggggcaagtccgtcgtcattaacactctgtgtcaggcccagaccaagcttgggctgacgacaaagttgtacatcctgaaccccaaagccgtgagtgtcatagaactctacggcatcctggacccaaccacccgagactggacagatggggtgttgtcaaacatcttcagggaaatcaacaagccaacagacaagaaggagcgaaagtatattttatttgatggtgatgtggatgctctatgggtggaaaacatgaattctgtgatggatgacaacaggttgttgacattggccaacggggaacgcatccggctccaagcacactgtgccctgctctttgaggttggagatttacagtatgcctcccctgcaactgtctctcgatgtggaatggtttatgtggatcctaaaaacttgaaatatcgaccatactggaaaaaatgggttaatcaaataccaaacaaggtggagcaatacaatttgaatagtctctttgagaagtatgtgccctatctcatggatgtgatagtggaaggaattgtggatggaagacaagcagaaaagctgaagacaatagttcctcagacagacctcaatatggtaacccagttagccaagatgttggatgcgttgctagaaggagaaatagaagaccttgacctgctggagtgctacttcctggaggctttgtactgctctctgggagcctccctgcttgaggatggaaggatgaaatttgacgaatatatcaaacgccttgcttctttgtctactgttgacacagaaggagtttgggccaaccctggggaactgccaggtcaacttccaaccttgtatgactttcattttgataacaaacggaatcaatgggtcccatggagtaaattagttccagagtatattcatgcccccgagaggaaattcatcaacatcctggttcacacagtggataccactcggactacctggatattggaacaaatggttaaaattaagcaacctgttatttttgttggtgaatctggcacttctaagacagccactacccagaatttcctcaaaaatctgagtgaagaaactaacattgtgttaatggtcaacttctcctcccgcaccacgtccatggatatccaaagaaatttagaagcaaatgtggaaaagcgaaccaaagatacttacggcccacccatgggaaaacgcctgctggtgttcatggatgacatgaatatgccaagggtggatgaatatggcacgcagcagcccattgccttgctgaagctgctgttggaaaaaggctacttatatgaccgtgggaaggagctgaactgtaaaagcattcgagaccttggctttattgctgcaatgggaaaggctggaggaggccgcaatgaagttgacccaagatttatttcgctattcagtgtcttcaatgtgccatttccttcagaggagtctctgcatttaatttattcctccatcctgaaaggccacacctcgacgtttcatgagagcattgtggctgtgagtggcaagctgacattctgcacgctagcactttacaaaaatattgtgcaagacctacctcccactccgtcaaagttccattacatcttcaaccttcgagatctctcacgggtttttaatggtcttgtcctcactaacccggagcgattccagacggtggcccagatggtgagagtctggaggaatgagtgtctgagagtcttccacgaccggctgatcagtgaaacagacaagcagctggtacaacagcacataggcagcttggttgtggaacattttaaagatgacgtggaggtggtgatgagggatcccatattgtttggagacttccagatggctctgcacgaaggagaaccacgcatttatgaagacatccaggactacgaggcggccaaggctctgttccaggaaattcttgaagagtataatgaaagcaacaccaaaatgaacttggttctcttcgacgatgctctggagcatttaacccgggtgcaccgtatcatccgcatggaccgcggccacgccctgctggtcggggtagggggctcagggaagcagtctctttcgaggctggctgccttcacagccagctgtgaggtgtttgagatcctgctgagccgaggctactcggagaacagtttccgggaagacctgaagagcctctatttgaaacttgggattgagaacaaagcgatgatctttctgttcacggatgcccatgtggctgaggagggcttcctggagctcatcaacaacatgctgacctcaggaattgtacctgcgcttttttctgaagaggagaaagagtctatcctgagtcagattggacaggaagctctgaagcaaggcatggggccggccaaggagtctgtgtggcagtacttcgtgaacaaaagtgcaaataacctgcacattgtcctgggcatgtcgccagtgggggacaccctgaggacctggtgcagaaacttcccaggtatggtaaataacactggtattgactggttcatgccctggcctccccaagccctccatgcggtcgcaaagtcctttctagggtataatccaatgatcccggcagaaaatatagaaaatgtggtgaagcatgttgtcttggttcaccaatccgtggaccactacagccaacagtttctacagaaattgaggcgcagcaactatgtcactcccaagaactaccttgattttattaacacctattcaaaattgctggatgagaaaactcagtgtaatatagctcagtgcaagcgtctggatgggggactggacaagctgaaggaggccaccatccagctggacgagctgaaccagaagctggccgagcagaagatcgtgctggcggagaagtccgccgcctgcgaggccttgctggaggagatcgccgtcaacaccgctgtagccgaggagaagaagaaactggcagaggaaaaggccatggagatagaggagcagaacaaagtcattgccatggagaaggccgaggccgagacgaccctggcagaggtcatgcccatcctggaggccgccaagctggaactgcagaagctggacaagtcggacgtgactgagattaggtcgtttgctaagcccccgaagcaggtgcagacggtctgcgaatgcatcctcatcatgaaagggtacaaagagctgaactggaaaacagccaagggcgtgatgtccgacccgaatttcctgcggtctctgatggagattgattttgattcgattacccagagccaagtgaaaaacatcaaaggcctcttgaagactcttaataccacaactgaagaaatggaagctgtcagcaaagccgggctggggatgctgaaatttgttgaagctgtaatgggctactgtgatgttttcagagaaatcaagcccaaaagagagaaggtggccaggctggagcggaatttttacctcactaaacgggaactggaaaggatccagaatgagttggcagcaattcagaaagagctggaaacattgggtgccaaatatgaggccgccatactggaaaagcagaagctgcaggaagaagccgagatcatggagaggcggctgattgccgcagacaaactcatctcgggtctggggtcagaaaacatcaggtggctgaacgacctggatgagctgatgcaccggcgcgtgaagctgctgggggactgcctgctctgcgcggctttcctcagctacgagggagccttcacctgggagttccgtgacgagatggtcaatcggatttggcaaaatgacatcctggagcgggagatccccctgagccagcctttccggctggaaagcctgctcacggatgatgttgagatcagcagatggggatcccagggccttccccccgatgagctctccgttcagaatggcatcctcaccacccgggccagccgcttccctctgtgtatcgacccccagcagcaggccctcaactggatcaagagaaaagaggagaagaacaatctgcgggtcgcttcctttaatgaccctgacttcctcaagcagctagagatgtccataaagtacgggacccctttcctgttccgcgatgttgatgaatacatcgatcctgtgattgacaacgtcttagaaaaaaatataaaagtctcccaaggacggcagtttattatcctgggagacaaggaagtggactatgattcaaatttcagactgtacctgaacaccaagctggccaatcccagatattccccatccgtgtttgggaaagctatggtgatcaattacactgtcacgctgaagggcctggaggaccagctgctgagcgtgctggtggcttacgagaggcgggagctggaggagcagcgggagcacctcatccaggagaccagcgagaacaagaacctgctcaaggacctggaagattccctccttcgggagctggccacgtccacggggaacatgctggacaatgtggacctggtgcacaccctggaggagaccaaatccaaggcaacagaggtctcagagaaactcaagctggcggagaagacagccttggacatcgacaggctgcgggatggctaccggccagcagccaggaggggggccatcctgttcttcgtcctgtctgagatggccctggtgaactccatgtaccagtactccctgattgccttcttagaggtcttcaggctgtcactgaagaagtcgctgcctgattccatcctcatgaaacgcctgaggaacatcatggacacgctgaccttcagcatctataaccacggctgcacagggctgtttgagaggcacaagctactcttttcttttaatatgaccatcaagatagaacaagcagaagggagagtccctcaagaagaactagatttctttttaaaaggaaacatttccctggagaaaagcaaaagaaaaaagccctgcgcttggttgtctgaccaaggatgggaagatatcattcttttatcagaaatgttttcagacaactttgggcaacttcctgatgatgttgagaataatcagactgtctggcaggagtggtatgacctggattcactggagcagtttcccgtccccttgggttacgataacaacatcacccctttccagaagttgcttattttgcgctgtttccgtgtggatcgggtctatcgggccgtgactgactatgtgactgtaacaatgggagagaagtatgtgcagcccccaatgatcagctttgaagctatttttgagcagagcactccacattcgcccattgtgtttatcctgagtcctggctccgaccctgccactgatcttatgaaattagcagagcgaagtggttttggaggaaatcgcctcaaattccttgcaatgggtcaaggtcaagaaaaggtggccctgcagctgctggagacggcggtggctcgggggcagtggctgatgctgcagaactgccacctcctggtcaagtggctgaaagatctggagaagtccctggagaggatcaccaagccccacccagacttccgcctgtggctcaccacggaccccaccaagggcttccccattgggattctgcagaagtccctaaaggttgtcaccgagccacccaatgggctgaaactcaacatgagggcaacttacttcaagatctctcacgaaatgctggaccagtgcccgcaccctgccttcaagccgctggtctacgtgctggcgttctttcatgctgtggtgcaggagagaaggaagtttgggaagattggctggaacgtgtactatgacttcaatgagtctgacttccaggtctgcatggaaattctgaacacgtacttaacgaaagccttccagcaacgggacccaaggatcccgtggggcagcctcaagtacctaattggagaggtcatgtatggaggacgggccatcgacagctttgatcgccgcatcctgaccatctacatggatgagtacctgggggacttcatttttgatactttccagccattccacttcttccggaacaaggaagtggactacaaaatccctgttggtgatgaaaaggagaaatttgttgaagccatcgaggccctcccgcttgccaacacgccagaagtgtttggtctccaccccaacgctgagattggctattacacgcaggcggctcgagacatgtgggctcacctgctggagctgcagcctcagacaggggaatccagcagtggtatcagccgcgatgattatattggccaagtggccaaagaaatagaaaacaagatgcccaaagtctttgacttggaccaggtgaggaagcgcctcggaacaggactctcccccacttcggtggtgctcctgcaggaactggaacgcttcaacaagcttgtggtccggatgacgaagtctctggctgaacttcaaagggccttggctggagaagttggaatgagcaatgagttagatgatgtggccaggtctctttttatcgggcatatccctaatatctggagaaggcttgctcctgacaccttaaagtcccttggaaactggatggtctacttcctgcggcggttcagccagtacatgttgtgggtgaccgagagcgagcccagcgtgatgtggctctcggggctgcacatccctgagtcctacctcacggcgctggtgcaggccacctgccggaagaacggctggccactggaccgctccaccttgttcacacaagtgaccaagttccaggatgcagatgaagtgaatgagcgggcgggacaaggatgctttgtctcaggactgtacctggaaggtgctgactgggatatagaaaaaggatgtcttatcaagagcaaacccaaggtgctggttgtggacctgccgatcctgaagatcatccccattgaagcccatcgcctcaagctgcagaatactttccggacccccgtctacaccacctccatgagaaggaacgccatgggagtcggcttggtttttgaagctgatctctttaccacgaggcacatttctcactgggtgctgcaaggagtatgcctcaccctgaattctgattaacctttgggtgaagaaaactgcttaatgaattcggagcctggggttgtcagagtgatcgggtctgctgtcatttcttggggcctctcaagaggcaggagggggactgacactgatttttcatttgaaatcagccacttaaatctctttccatacaaattaacctgaatggttttgtttttaatactactttttaaaaggaatttatataatcaaaaagtaaatattggagagta

SEQ ID NO: 128499 - DNA, 3890 bp, Homo sapiens; identical to SEQ ID NO: 128492
  Payload ID: 5150
  Gene Symbol: DNAH10
  Gene Name: dynein, axonemal, heavy chain 10
  ENST ID: ENST00000632605
  CDS Start-End: 1-1947

SEQ ID NO: 128500 - DNA, 5040 bp, Homo sapiens
  Payload ID: 5151
  Gene Symbol: DNAH10OS
  Gene Name: dynein, axonemal, heavy chain 10 opposite strand
  Uniprot ID: P0CZ25
  ENST ID: ENST00000514254
  CDS Start-End: 402-893
cacctctggaaggaccggcatccacacacacatacagccgcgccttttccaggaagcagctatccgtagcttttatcacggctccaagactctccccagcccataaagcttaggcacccctgttttaaaaagtaggactgttggaaaccacctcagccataactacagtcagaagaggaagggccctggtgtcagagaggaggggctgggaccttcacctgcagcttgaggcgatgggcttcaatggggatgatcttcaggatcggcaggtccacaaccagcaccttgggtttgctcttgataagacatcctttttctatatcccagtcagcaccttccaggtacagtcctgagacaaagcatcctagggacacaaggcagagactggatacaactggagcatgcacagcctgccacggagtggctctatcaggcgcacacacagcgacacacaggccactggctggcctcctccccagcgcattggggacagcccaggcccttctccagcatttctgtcctgcccaccttccctctgtggaggagcagcccagacaggagaccctgtggccctgccccatggcccagagaaatgggtgtggggcggtggcctctcccccaggaatcctcattcctggggcatcaaggcccacggacttagaccaccctgggcccccaggctagaaagatgcatggtcccagagtcagaatgggcaccatggcaaccccagctaccctgtgagccgaagtggctggggagcaggaagtcgaagcctcacagagaaagtggtctccggggaggaggacccagcagatgtgcaaagagaggaacacactcctgtggccccagagagagtggtggcccggacacctgccacctcccctgccactgagacctggagagtccctgcatctttaccggattttgtagtccacttccttgttccggaagaagtggaatggctggaaagtatcaaaaatgaagtcccccaggtactcatccatgtagatggtcaggatgcggcgatcaaagctgtcgatggcccgtcctccatacatgacctgaaattagagggcctgagagccagccaggagctcagaacctactgtgtgcaccctgggggcccggggccagaggctcacccagggtcaagagactccagcagcctggctgctgcaaggcttgaacctgttgacttgcataacctttcgggccactgttcacacaattgatctgtggctttgctggcttcccaagggatagggcccaaagcagtaagaagccctcaggaagtgttgggagctcctgtgcagcaggcaaagtcccccaaacacatcaaacaaacagctgaagaagccagcagctgcttctgtctttggaattgatgtcactgcctgagccgtgtgcagaccaccggggatgcttcctgtgagctctgtatacagcaacagctgaggcaaggggctagaggatgccttgcctggatccccagccatggatccagctcagggaacctccatgtgaacagagctcacttaggacaaagaacaaccaggtgagagcagagagaattgtcacagaaacccaaggggaacacaggggcagaagaggctggttctgagggctcagaggaaaataggggcacgaggccacagctctgtagccccagaggcacctgcggaaggatccccggtcacccctacctctccaattaggtacttgaggctgccccacgggatccttgggtcccgttgctggaaggctttcgttaagtacgtgttcagaatttccatgcagaccttgaaagaagagaacacgctcagttatactgaaacccaccaagctgttcacattctgatacttttctgaaaaggctgctgggaacggtgcaaccctgctgtggttgaacccggaggaaagtcgggaggaagtgggccgcctaaggaagccatttccaaggagaagcagccactgtcacctggaagtcagactcattgaagtcatagtacacgttccagccaatcttcccaaacttccttctctcctgcaccacagcatgaaagaacgccagcacgtagaccagcggcttgaaggcagggtgcgggcactggtccagcatttcgtgagagatcttgaagtaagttgccctcatgttgagtttcagcccattgggtggctcggtgacaaccttcagaagagaagaaaacacacagtgatggagaccgcaggcccacaagcttggaagagtgtgcacaatgcaggcactgcgctttccttcctctctacggagccatctgtctgagacctccaatagctaaagtctcttgtccagggcccaggctgagaagttaaaggactagatgttctggctctcagggtcaagggtcaagagtctttgaccttcctctgaaccatgagatcctttactatatataaaatgaaagtaaagtcttccctccacctccccagagagagagagagagacagagaatgacaaaacctttccaaaagaatttcccggagaataaattaaatggggcatgtaaaccacgcgaaactcctgcagtcagcactagcgaactgcaggctgtgtgtgggggggggggccgtgaagtttatgaaaagtagcgtagatattgttagggacacatgcagaattggtagagataggcctgggagtcacaaacacccaacccaggacagcggctccctctaaagagagaggtgggattgagaagggtttcaaccgcaaggtttcacctgcagcctaaggtttatttctacacagacaaaggcacaccccggccccagagcagcatgcaggtgttctgagaagctgcgtgctggcatgttgatgtccatcctgaagccagacctttagggacttctgcagaatcccaatggggaagcccttggtggggtccgtggtgagccacaggcggaagtctgggtggggcttggtgatcctctccagggacttctccagatctttcagccacttgaccaggaggtggcagttctgcagcatcagccactgcccccgagccaccgccgtctccagcagctgcagggccacctgcgccgggggagagggaagaggagaggggttggcatccaaacccaaccccgtgctctccagagacccactccacacccacagaagggcgatggcagctccagcagaagccaaaagcaagccgaggatccaggagctacaggtggagccttcaaataaaccatctttgagaaaccccatgggccccgtgggtgcactgagctggtcacacccagcctggaagatgggtgagcattttgcactcatctgcctccctggccctggaagtcccagctcctcccacacagtcgctcctgtcccctgaggactcctgagcagggctgcaagagaccagctaaagcccaccaggaagtcgggactgtcctggccactgtaagatcttcagggccctaggcctggaaaacaatcaccatgtcccctcccaaatgtaattcaaagcacaaacaagctaaacacccaaatcaagccttgctttctgaaatggcttaaaacacatgagtgctggcgttacaatagcttatttcagtgttgtggttgagagagctggcccgccttgctggtgcccagggcttgcctcctgggccatccagcatgggtattgccatcctcatctcacccaggggctttcagcagtagaggggcttacccaaagcctcacagttcatagcaaagccaggactggcagtcagctccctctgaccccaacacgcatgcctgcaaccatcacacttactgacgcacagacttttcctgcaagctttgtcccacattgtactgaacttgtgtagcaagttctagcagggagcactgtgatgcagagaggcaagacctcagcaaagaaagctcactggctcagaaaggtaggaggatttgcaccacagttctgtcctgaatggtcctgggctcagcctctctccacccactcccttggccatgcaattggggccataataatcctgatccacaatgaggctgttcagggactaaggaaggtaaggactgtgtgtgaaagggctttgaaaacagcacagcctgagcatcgtgtctcatgcctgtgatcccaacactttgggaggccgaagtggaaggatcgcttgagcccaggagttcaagaccagccagggcaacatggtgacgtgtttgtatttttctctacagaaaataccaaaaaaattagccaggcatggtgacgcatgcctgtagtctcagctgctactggggaggctgaggcaggacgatcacttcacaatcaggaggtcgaggctgcagtgagctatgttcgcaccactgcactccagcctgggtgacagagtgagaccctgtctcaaaaagaaaagaaaaaggaaaaaaaaagaaaacagcacagcaccatgatcacaacatgaggttgtgaaatcataactattattgtcatcttcccagtgtttcattactgcttcttagctcggaaatgcatccaactgatttgtggcgtggcactcagcttaaacccaggttagctccttcttagcagacaccagggacctcccctaaacgtagagcttgttcctttcagccacaaattaccttttcttgaccttgacccattgcaaggaatttgaggcgatttcctccaaaaccacttcgctctgctaatttcataagatcagtggcagggtcggagccaggactcaggataaacacaatgggcgaatgtggagtgctctgctcaaaaatagcttcaaagctgatcattgggggctgcacatacctggtgaaagaaacacagtcagaaaactctcccgcgaggacagctccagaccaggggctggtctgtctgatcagcgctgcctcctccggtgtccagaaccttctgaccactcctctgggatagctcgttgcagtcttccctgttttagattctagtttctatgcacgtctcccaccctgatggggaactcctgagtggcagggacttctctgt

SEQ ID NO: 128501 - DNA, 13917 bp, Homo sapiens
  Payload ID: 5152
  Gene Symbol: DNAH11
  Gene Name: dynein, axonemal, heavy chain 11
  ENST ID: ENST00000328843
  CDS Start-End: 32-13603
ccggcctcgcgttccctcggacggttgcccaatggcagcccaggtggcagcccgggaggcgcgagacttcagagaagccccgacccttcgcctaacctcgggggccggcctggaggcagtgggcgctgtggagctcgaggaggaggaggagaacgaggaggaggcggcggccaggagagcgcggagtttcgcccaagacgcgcgggtgcgcttcctcggcggccgcctggcgatgatgctggggttcacggaggagaaatggagccagtatttggaaagcgaggacaaccggcaggttcttggggagtttctggaaagcaccagcccggcttgccttgtgtttagcttcgccgcctcggggcgccttgcggcttcccaggagattccaagagatgcaaaccataaacttgtttttatttccaagaagattactgaaagcattggagtaaatgacttttctcaagtggttttatttggagagttacctgcgttgtctcttggacatgtatctgctttccttgatgagattttagtgccagttctttctaataagaacaaccataagtcctggtcctgttttacttcacaagatatggaatatcacatagaagtcatgaaaaagaagatgtatatttttaggggcaaaatgtctagaagaactcttctaccaattcccactgttgcaggaaagatggatctggatcagaattgttcagagaacaagccaccgtcaaacgaaaggataatacttcatgcaattgaatctgtggttattgaatggtcacatcaaatccaagaaattatagaaagagattcagtgcagcgtttgttgaatggtcttcacttgtctcctcaagcagaactagatttctggatgatgaggagagaaaatctgtcatgcatttatgatcaacttcaggcacctgttgtcctcaaaatggttaagatcctgacaactaaacaaagcagctattttcctactctgaaggacatttttctggctgtggaaaatgctcttctcgaagcccaagatgtggaactttacctgagacctctgaggagacacatccagtgtctccaggagacggaattcccacagacacgcatattaatcgctccattatttcataccatctgtctgatctggagtcattccaagttttataacaccccagctcgggttatagttttattgcaagagttttgtaatctcttcattaaccaggcaacagcttacctttcacctgaggaccttttgaggggagaaatagaagagtcactggaaaaggtgcaggtggctgttaacatcttaaagactttcaaaaactcctttttcaactatagaaaaaaattggcaagctactttatgggaagaaagctgagaccatgggatttccagtctcatctggtgttttgcagatttgacaagtttcttgatcgtttaataaaaatagaggatatatttgccaccactttggaatttgaaaagctggaaagactggaatttggtggtaccaaaggagcaattttaaatggacaagtccacgagatgagtgaagaacttatggaactctgtaaactttttaaacagagcacttatgacccatctgattgcactaacatggagtttgaaagtgattatgtggcatttaagtccaaaactctggaatttgacagaaggcttgggacaattatttgtgaagctttctttaactgcaatggcttagaagctgcatttaagcttttgaccatatttggaaattttctagagaagccagttgtcatggaaattttcagcctacattacagcacactagtgcatatgtttaatacagagctggatgtgtgtaagcaactgtataatgaacacatgaaacagattgaatgtggtcatgtagttcttaacaagaacatgccatttacctcaggaaatatgaaatgggcccagcaggttctccaacgacttcaaatgttttggtcaaacttcgcatctctccgttatctatttttgggcaatcctgatcacgctttagtttatcaaaagtatgttgaaatgaccactttgcttgatcaatttgaaagtcgtatctataatgaatggaaaagtaatgtggatgaaatctgtgaattcaatttgaatcaacccttggttaaattcagtgccataaatggtcttctctgtgtcaattttgacccaaagctagtggctgtattgagagaagtgaaatatcttttgatgttgaagaaacaagacataccagattcagctttagccatcttcaagaaaaggaacactattttaaagtacattggaaatcttgaccttcttgtgcaagggtataataaactcaaacagacgctcctggaagttgaataccctctgattgaagatgagctgagggctattgacgagcagctgacagcagccacaacgtggctgacatggcaggatgactgctggggctacatcgagagggtgagggcagccacgtccgagttggagcacagagttgagcgcacacagaaaaacgtgaaggtgatccagcagaccatgaggggctgggccaggtgcgtgctacctcccaggagagagcacagacgagaggcagccttcaccttggaggacaagggtgatttgtttacaaaaaaatacaagttaatccaaggagatggctgcaagatccacaacttggtcgaggaaaataggaagctcttcaaagccaatccctctctggatacctggaaaatttatgtagaattcattgacgacattgtggtggaaggcttttttcaggctataatgcacgacttagacttctttctgaagaatacagagaaacaattgaaaccggcaccgttttttcaagcacaaatgatcttgttgcctcctgagattgtgtttaaaccttccctagacagagaggctggggatggcttctatgatcttgtagaagaaatgttatgcaatagttttagaatgtctgcccagatgaaccgaatagcaacacacctggaaattaaaaattatcagaatgatatggataacatgttaggcctggcagaggtcaggcaggagatcatgaacagagtggtgaatgtcatcaacaaagtcttagatttcagaaacaccctggagacccacacttacctctgggtggatgatcgagctgagtttatgaagcattttctcttgtatggccatgctgtgtcttccgatgaaatggatgctcatgcaaatgaagaaattcccgaacaaccaccaactcttgagcaattcaaagaacagattgacatttatgaagctttgtatgttcaaatgagcaaatttgaggactttagagtgtttgatagttggttcaaggtggacatgaagcctttcaaagtgagcttgttaaccataattaagaaatggagctggatgtttcaggagcatcttttgagatttgtcattgacagtctgaatgagctacaagaatttataaaggagacagattccggacttcagagagaattaaatgaaggtgatcatgatggtttagttgacatcatggtgcatcttctggctgtaagaagccgacagagagctactgatgaactctttgaacctctaaaagaaacgatcaccctcttggaaagctatggccagaagatgcctgagcaggtctatattcagctagaggaattacctgaaagatgggaaactaccaaaaagatcgcagcaactgtcagacatgaagtctcacctctccataatgcggaagtcactcttataaggaaaaaatgtattttgtttgacgcaaagcaggcagagttcagagagagattcagacactatgcccctcttggatttaatgcagaaaatccatacacagcgcttgataaggcaaatgaagagcttgaggccttagaagaagaaatgttgcagatgcaagaatctactcgtctttttgaagtggctcttccagagtacaaacaaatgaaacagtgtcgcaaagaaataaaattgctcaagggactgtgggatgtcattatttatgttcgaagaagcattgataattggactaaaacccagtggagacagattcatgtggaacagatggatgtagaactcagaaggtttgccaaggcgagttccataactgaaatttggtcactcaacaaggaagtccgcgtctgggatgcttacacgggcctggaaggcacagttaaggacatgacagcctccctgagggccatcacagagttacagagccctgccctcagggacaggcattggcaccagctgatgaaagctattggggtcaagtttttaataaatgaagccacaactttggcagatttgttagcactgcggttacacagagtggaagatgatgtccgaaggattgtggacaaggcggtgaaagagctggggactgagaaggttattactgaaatcagtcagacctgggcaaccatgaagttttcttacgaagttcactatcgaacaggcattccattactaaagtctgatgaacaactttttgaaactctagagcacaaccaagttcagttgcagactcttcttcaaagcaagtatgtagaatatttcattgagcaagtgttaagctggcaaaataaattaaacatagcagacttggtcatcttcacttggatggaagtccagcgaacttggtctcacctggaaagcatttttgtctgttcagaagatattcgaatccagcttgtgaaagatgctagaagatttgatggggtggatgctgaatttaaggagttaatgttcaagacagccaaagtagaaaatgtgttagaagcaacgtgcagacctaatctctatgaaaaacttaaagatttacagtccaggctttctctttgtgaaaaagctctcgctgaatacctggaaaccaagcgcatagcctttcctcgcttctatttcgtctcttctgctgatttacttgacattctctcaaaaggagctcagcctaaacaggtaacatgtcaccttgccaaacttttcgacagcattgcagatctgcagtttgaagacaatcaggatgtttctgcacacagggcagttggaatgtacagcaaagaaaaggagtatgtcccattccaagccgagtgtgaatgtgtgggccatgtggaaacatggcttctgcaacttgaacagactatgcaagaaacggtgcgtcattctataacagaagccatagtggcctacgaggaaaaacctagggaactgtggatttttgatttcccagctcaggttgcactaaccagctcacaaatatggtggaccacagatgtaggaatagccttcagtagactggaagaaggctacgaaacagccctgaaggatttccataaaaaacagatttctcagctgaatacactgattacacttttgctgggagaacttccacctggagacagacagaagatcatgacaatttgtaccatagatgtccatgccagagacgtggtggcaaaacttatttctcagaagaaagtggttgtcagtccccaagcttttacatggctgtctcaacttcgtcaccgatgggaggatacccagaaacactgctttgttaatatttgtgatgcccagttccagtacttctatgaatacttaggaaacagccctcgactagtgatcactcctctaactgacaggtgttatattaccttaactcaatcacttcatctaaccatgagtggggctcctgctggcccagctggtaccgggaaaacagagaccaccaaagacctaggacgtgcccttggcatgatggtctatgtattcaactgttcagagcaaatggactacaaatccataggcaatatctataagggattggtgcagacaggagcttggggctgctttgatgagttcaaccgaatctctgtggaagttctgtcagtggtggcagtacaagtgaaaatgattcatgatgccatcagaaacaggaagaagagatttgtatttcttggggaagctatcacactgaagccatcagttggaatatttattactatgaacccgggttatgctggtcgaaccgaattaccggaaaatctcaaagctcttttcagaccctgtgccatggtggcccctgacattgagctaatctgtgaaatcttgttagttgctgaaggttttgtggatgcgcgtgcattagcccgaaagttcattacgttgtacacgctttgcaaggagcttctctccaagcaggatcattacgactggggacttcgtgctattaagtctgtcttggttgtggctggatctctgaaacgaggagataaaaatagacccgaagatcaggtactcatgagagcattaagggatttcaatatgcccaaaatagtgactgacgacatcccagtgtttctgggcctggtcggtgacctgtttccagccctggatgtgccccggaggaggaagctgcactttgaacagatggtcaggcagtctaccctggagctccgcctgcagcctgaagagagcttcatcctcaaagttgtccagcttgaggaactgttggctgtgcggcactcggtctttgtagttggaaatgcaggcacaggaaagagtaagattttgagaacactgaaccgaacatatgttaacatgaaacagaagccggtttggaatgacttaaaccctaaagctgtgacaacagatgaactctttggtttcatacatcatgctacccgagaatggaaagatggcaagattgtttactcttattttataggtctcttctcatccattctacgagaacaagcaaatcttaagcatgatggaccaaaatggatagtcctggatggcgatattgaccccatgtggattgaatcactgaatactgtaatggatgataacaaggtgctgaccctcgccagcaatgagcgcattgcactcactcccttcatgaggcttctgtttgagatacatcacttaaggagcgcaaccccggccactgtttccagagctggtattctgtatgtgaacccacaagatctgggctggaatccgtatgtggccagttggatagacagaaggcggcatcaatcagaaaaggccaatttgactattctttttgataaatatgtccctgcatgcttggataaactgagaacaagctttaaaaccatcacttcaattcctgagagtagcctggtgcagactctatgtgttcttttggagtgcttgctgactcctgaaaatgtaccttctgacagcccaaaagaagtttatgaagtctattttgtatttgcttgtatctgggcttttggaggcaccctgctacaagatcagatttctgattatcaagctgacttcagtcggtggtggcagaaagagatgaaagcagtgaaatttccgtcgcagggaacaatctttgattattatgtggaccacaaaactaagaaattattgccctgggctgacaaaattgcccagtttactatggatccagatgtgcctctgcagacagttctcgttcacacaacagagacagctcgtcttagatatttcatggagttgttgcttgagaaaggaaaacctctaatgctagtaggaaatgcaggagtgggaaaaacagtctttgtaggtgacacattggcaagtctctctgaggattacatagtatcccgtgtgcctttcaactactacacgacatccacagctctgcaaaaaattcttgagaaacccctagagaaaaaagctggtcataactatggtcctggaggaaataaaaaattgatttattttatcgacgacatgaacatgcctgaagtggacttatatggcaccgttcagcctcacaccctgatccggcagcatattgattatggacattggtatgatagacagaaggtgatgcttaaagaaatccataactgccagtatgtcgcctgcatgaatccgatggtgggcagcttcaccatcaatcccaggctacagagacatttcacagtgtttgcattcaattttccatctttggatgcactaaacaccatctatggccaaatctttagcttccatttccaacagcaagcatttgctccatcaattctcaggagtggccccactttgatccaggcaacaatagcattccatcagacaatgatgtgtaactttttacccacggctattaaattccactacatctttaatctgagagatttatcaaacgtcttccaggggattttatttgcttctcctgagtgtttaaaaggtccacttgatttaatacatctgtggcttcatgaatctgcccgtgtttatggagacaaactgatagacaaaaaagattgtgatttgtttcagagaagaatgctggaaactgcttataaatattttgaaggtatagatagtcacatgctgcttcaacagcccctcatttattgccactttgctgatagagggaaggacccacattacatgccagtgaaggactgggaagtgctgaagacgattcttacagaaacgttagacaactacaatgaactaaatgctgccatgcacctagttttgtttgaagatgccatgcaacatgtgtgtcgcatcagccggatcttacgaacccctcagggctgtgctctcttggttggagttgggggcagtggcaagcagagcttgtccaggctggcagcttaccttcgtggccttgaggtctttcagatcactctgaccgagggctatggaatccaggaacttcgggtagatcttgccaatttgtacatccgaactggagccaagaacatgcccactgtgttcctgctgacagatgcccaggttctagatgagagcttcctcgtgctgattaatgacttgctggcatcaggagaaatcccagatctgttcagcgatgaagatgtggacaagataatttctggaattcataatgaagttcatgctctgggcatggtagactccagggaaaactgttggaaattctttatggccagggtgcgactacagctcaaaatcattttgtgtttctctccagttggtcgcacgctgagagttagagctcggaagttcccagccatagttaactgcacggctattgactggtttcatgcgtggccgcaggaggctctggtctccgtcagcaggaggttcattgaggaaaccaagggaattgagccagtgcacaaagactctattagccttttcatggcacatgttcacaccactgtaaatgaaatgagtaccagatattaccagaatgagagaagacacaactataccaccccaaagagttttctagaacaaatatcactgtttaagaacctgttgaagaagaagcaaaatgaggtatccgagaaaaaagaacgcctggtgaacggcatccaaaagctaaaaaccacagcctctcaggtgggagatctaaaagccagacttgcctctcaagaagccgagctgcaactgagaaatcatgatgccgaagctctgatcacaaagatcggccttcagacggagaaagtgagccgggaaaagaccatcgctgatgctgaggagcgaaaggtgacagccattcagactgaagtgttccagaaacagagagaatgtgaagctgacttactcaaggctgagcctgcactggtggctgctacagctgcactcaatacactcaacagggtcaacctcagtgagctgaaagcctttcccaaccctcccatcgcagttaccaatgttactgcagccgtgatggtccttctggctcctcggggaagagtgcccaaagaccgaagttggaaagcagctaaagtcttcatgggaaaggttgatgattttttgcaagcattaattaactatgacaaagagcacattccagagaactgtctaaaagtggtgaatgaacactatttgaaagacccagagtttaatccaaacctgattcgaaccaaatcttttgcagcagctggcctgtgtgcctgggtcatcaacatcattaaattctatgaggtctactgtgatgtggagccaaaacgccaagcattagcccaagcaaacttagaactggctgcagctactgaaaaactagaggctatcaggaaaaagcttgtggatctggatcgaaatctgagcagactcacggcttcatttgaaaaagcaacagctgagaaagtccggtgtcaagaagaggtgaaccaaaccaacaaaaccatcaaattagctaacagacttgtcaaggaacttgaggcaaagaagattcgctggggtcaatccattaagtcctttgaagctcaagagaagacactctgtggagatgttcttctcacggcggcatttgtgtcttacgtcggacccttcacaaggcagtatcgccaggagctggtgcactgcaagtgggttccctttcttcaacagaaggtttccattccactaaccgaaggcctggacttgatatccatgttgacggatgatgctacaattgccgcctggaataacgaaggactgcccagtgacagaatgtccaccgaaaatgccgctatcctaacacactgtgagcgctggcctctggtgatagatccccagcaacagggaattaagtggatcaagaataagtatggaatggacctgaaagtcacacatttgggccagaaagggtttttgaatgccattgaaactgctttggcctttggtgatgtcatcttaattgaaaatctcgaggaaacgatagatccagtcctggatccactacttggcaggaacacaattaaaaaaggaaagtatatcaggattggagataaagaatgtgaatttaacaagaactttcgccttatccttcacacaaaattggcaaatcctcactataagccggaattacaagctcagacaactctcctcaatttcacagtcacagaagatggtctagaagcccagctgctggcagaggttgtcagtattgaaaggccagatttggagaaacttaagttggtattgacaaagcaccaaaatgattttaaaattgagctcaagtatctggaagacgatctccttttgcgcctttctgcggcagagggaagctttctggatgacaccaaactggtagagagattggaggcaacaaagaccaccgtggcagagatagagcacaaggtgattgaagccaaagaaaatgaaagaaaaatcaacgaggcccgagaatgttacagaccagtggcagcaagagcatctcttctttattttgttattaatgacctccaaaaaatcaaccccctctaccaattctctttgaaggcttttaacgtgctgttccacagagcgatcgagcaggctgacaaggtggaagacatgcagggacgcatctctatcctgatggagagcatcacccatgctgtcttcctctacaccagccaggcgctgtttgagaaggacaagctcaccttcctgtcccagatggcttttcagattttgttgagaaagaaagagatagaccctcttgaattggatttcctgcttcgattcacagttgaacacactcatctgagtcccgttgacttcctaacttctcagtcatggagtgctatcaaggcaattgccgtcatggaagaatttcgaggcatagaccgagatgtggaaggatctgccaagcagtggaggaagtgggtagaatccgagtgtccagaaaaagaaaaattacctcaagaatggaagaagaaaagtttaatacagaagctgattcttctgagagcaatgcgccctgacagaatgacgtatgctctcagaaattttgtagaggaaaaactgggtgcgaagtatgtggagaggaccagattggacttagttaaagcattcgaagaaagcagcccagccacccccatattcttcatcctgtctccgggggtagatgcccttaaagacctggagattcttggcaaaagacttggctttacaattgactctggaaaattccacaatgtgtctttaggacaaggtcaggagacggtggcagaagtggccctggagaaagcttccaaaggaggacactgggtcatcctccaaaatgttcatttggtagccaagtggctaggaaccttggagaagctccttgaaagattcagccaaggaagccacagagattacagggttttcatgagtgctgagtctgcacctacaccagatgagcatatcatccctcaaggactcctggaaaattccattaagatcactaatgaacccccaacagggatgctggccaatttgcatgccgccctgtacaactttgatcaggatacacttgaaatatgctccaaggagcaggagtttaaaagcatccttttttctctctgctacttccacgcctgtgttgctgggagactgaggtttggcccccagggctggagccgaagctatccttttaatcctggagacctcaccatttgtgccagtgtcctctacaactacttagaggcaaactctaaagtcccatgggaagatctccgttatctctttggtgagatcatgtatggaggccacatcacagatgactgggatcgcaaactgtgtcgggtgtatttagaagaattcatgaatccatctctgactgaagatgaactgatgctggcaccaggttttgctgccccaccctacctagattatgcaggctaccaccagtacatagaggagatgcttcctccagaaagcccggcactgtatggcctccacccaaatgctgaaatagaattcctgacagtgacatccaacactctcttcagaactttgctggagatgcagcccaggaatgcactcagtggtgatgaactggggcagtctacagaagaaaaggttaagaatgtcttggatgacattttggagaaacttccagaagagttcaacatggcagagataatgcaaaaaaattcaaatagaagcccatatgttcttgtttgcttccaagaatgtgagaggatgaatattctcattcgggaaatacgtatatcacttgaacaactggaccttagtttgaagggggaattggcattatctcctgctgtggaagcccagcagtttgcattgagttatgacacggtaccagacacttggagcaaactggcttatccttctacttatggcctagcccagtggttcaatgacctcctcctgcgatgccgagaactcgatacttggacacaagaccttacccttccggctgtcgtgtggctctccggcttcttcaaccctcagtccttcttaactgcaatcatgcagacgatggctcgaaaaaatgagtggcccctggataaaacgcgcttgactgctgatgttaccaaaaaaacaaaggaagattatggacacccgccaagggaaggtgcatacctccacggactcttcatggagggcgcccgctgggacacccaagcaggaaccattgttgaagcccgtctcaaggagctggcatgccctatgccggtcatctttgcaaaagccacccccgtggacagacaagaaaccaaacagacctacgagtgccctgtgtatagaaccaaactgagaggccccagctacatctggaccttcaggctgaagagcgaagagaagactgcaaaatgggttctggctggagtggctctgcttctagaagcgtaaggtaacactggcattcctctagcctctgctggagtgcagtgaggattttctagcatgttgctgcactgttcccatgcacattattctaactttttagtaactcacacgtgcattcttttttcaacgctatccttagagtgaaagtcagaaaaaaatactagaaactaactcagggctgagcgtggtggcacacgactgtaatcccagttactcaggaggtaggagaatcacttgaacctaggaggcaaaggttgcagtgagccgaggttgcaccactgcactccctcctgggcaacagaacaagactccatctc

SEQ ID NO: 128502 - DNA, 14167 bp, Homo sapiens
  Payload ID: 5152
  Gene Symbol: DNAH11
  Gene Name: dynein, axonemal, heavy chain 11
  Uniprot ID: Q96DT5
  ENST ID: ENST00000409508
  CDS Start-End: 32-13582
ccggcctcgcgttccctcggacggttgcccaatggcagcccaggtggcagcccgggaggcgcgagacttcagagaagccccgacccttcgcctaacctcgggggccggcctggaggcagtgggcgctgtggagctcgaggaggaggaggagaacgaggaggaggcggcggccaggagagcgcggagtttcgcccaagacgcgcgggtgcgcttcctcggcggccgcctggcgatgatgctggggttcacggaggagaaatggagccagtatttggaaagcgaggacaaccggcaggttcttggggagtttctggaaagcaccagcccggcttgccttgtgtttagcttcgccgcctcggggcgccttgcggcttcccaggagattccaagagatgcaaaccataaacttgtttttatttccaagaagattactgaaagcattggagtaaatgacttttctcaagtggttttatttggagagttacctgcgttgtctcttggacatgtatctgctttccttgatgagattttagtgccagttctttctaataagaacaaccataagtcctggtcctgttttacttcacaagatatggaatatcacatagaagtcatgaaaaagaagatgtatatttttaggggcaaaatgtctagaagaactcttctaccaattcccactgttgcaggaaagatggatctggatcagaattgttcagagaacaagccaccgtcaaacgaaaggataatacttcatgcaattgaatctgtggttattgaatggtcacatcaaatccaagaaattatagaaagagattcagtgcagcgtttgttgaatggtcttcacttgtctcctcaagcagaactagatttctggatgatgaggagagaaaatctgtcatgcatttatgatcaacttcaggcacctgttgtcctcaaaatggttaagatcctgacaactaaacaaagcagctattttcctactctgaaggacatttttctggctgtggaaaatgctcttctcgaagcccaagatgtggaactttacctgagacctctgaggagacacatccagtgtctccaggagacggaattcccacagacacgcatattaatcgctccattatttcataccatctgtctgatctggagtcattccaagttttataacaccccagctcgggttatagttttattgcaagagttttgtaatctcttcattaaccaggcaacagcttacctttcacctgaggaccttttgaggggagaaatagaagagtcactggaaaaggtgcaggtggctgttaacatcttaaagactttcaaaaactcctttttcaactatagaaaaaaattggcaagctactttatgggaagaaagctgagaccatgggatttccagtctcatctggtgttttgcagatttgacaagtttcttgatcgtttaataaaaatagaggatatatttgccaccactttggaatttgaaaagctggaaagactggaatttggtggtaccaaaggagcaattttaaatggacaagtccacgagatgagtgaagaacttatggaactctgtaaactttttaaacagagcacttatgacccatctgattgcactaacatggagtttgaaagtgattatgtggcatttaagtccaaaactctggaatttgacagaaggcttgggacaattatttgtgaagctttctttaactgcaatggcttagaagctgcatttaagcttttgaccatatttggaaattttctagagaagccagttgtcatggaaattttcagcctacattacagcacactagtgcatatgtttaatacagagctggatgtgtgtaagcaactgtataatgaacacatgaaacagattgaatgtggtcatgtagttcttaacaagaacatgccatttacctcaggaaatatgaaatgggcccagcaggttctccaacgacttcaaatgttttggtcaaacttcgcatctctccgttatctatttttgggcaatcctgatcacgctttagtttatcaaaagtatgttgaaatgaccactttgcttgatcaatttgaaagtcgtatctataatgaatggaaaagtaatgtggatgaaatctgtgaattcaatttgaatcaacccttggttaaattcagtgccataaatggtcttctctgtgtcaattttgacccaaagctagtggctgtattgagagaagtgaaatatcttttgatgttgaagaaacaagacataccagattcagctttagccatcttcaagaaaaggaacactattttaaagtacattggaaatcttgaccttcttgtgcaagggtataataaactcaaacagacgctcctggaagttgaataccctctgattgaagatgagctgagggctattgacgagcagctgacagcagccacaacgtggctgacatggcaggatgactgctggggctacatcgagagggtgagggcagccacgtccgagttggagcacagagttgagcgcacacagaaaaacgtgaaggtgatccagcagaccatgaggggctgggccaggtgcgtgctacctcccaggagagagcacagacgagaggcagccttcaccttggaggacaagggtgatttgtttacaaaaaaatacaagttaatccaaggagatggctgcaagatccacaacttggtcgaggaaaataggaagctcttcaaagccaatccctctctggatacctggaaaatttatgtagaattcattgacgacattgtggtggaaggcttttttcaggctataatgcacgacttagacttctttctgaagaatacagagaaacaattgaaaccggcaccgttttttcaagcacaaatgatcttgttgcctcctgagattgtgtttaaaccttccctagacagagaggctggggatggcttctatgatcttgtagaagaaatgttatgcaatagttttagaatgtctgcccagatgaaccgaatagcaacacacctggaaattaaaaattatcagaatgatatggataacatgttaggcctggcagaggtcaggcaggagatcatgaacagagtggtgaatgtcatcaacaaagtcttagatttcagaaacaccctggagacccacacttacctctgggtggatgatcgagctgagtttatgaagcattttctcttgtatggccatgctgtgtcttccgatgaaatggatgctcatgcaaatgaagaaattcccgaacaaccaccaactcttgagcaattcaaagaacagattgacatttatgaagctttgtatgttcaaatgagcaaatttgaggactttagagtgtttgatagttggttcaaggtggacatgaagcctttcaaagtgagcttgttaaccataattaagaaatggagctggatgtttcaggagcatcttttgagatttgtcattgacagtctgaatgagctacaagaatttataaaggagacagattccggacttcagagagaattaaatgaaggtgatcatgatggtttagttgacatcatggtgcatcttctggctgtaagaagccgacagagagctactgatgaactctttgaacctctaaaagaaacgatcaccctcttggaaagctatggccagaagatgcctgagcaggtctatattcagctagaggaattacctgaaagatgggaaactaccaaaaagatcgcagcaactgtcagacatgaagtctcacctctccataatgcggaagtcactcttataaggaaaaaatgtattttgtttgacgcaaagcaggcagagttcagagagagattcagacactatgcccctcttggatttaatgcagaaaatccatacacagcgcttgataaggcaaatgaagagcttgaggccttagaagaagaaatgttgcagatgcaagaatctactcgtctttttgaagtggctcttccagagtacaaacaaatgaaacagtgtcgcaaagaaataaaattgctcaagggactgtgggatgtcattatttatgttcgaagaagcattgataattggactaaaacccagtggagacagattcatgtggaacagatggatgtagaactcagaaggtttgccaaggaaatttggtcactcaacaaggaagtccgcgtctgggatgcttacacgggcctggaaggcacagttaaggacatgacagcctccctgagggccatcacagagttacagagccctgccctcagggacaggcattggcaccagctgatgaaagctattggggtcaagtttttaataaatgaagccacaactttggcagatttgttagcactgcggttacacagagtggaagatgatgtccgaaggattgtggacaaggcggtgaaagagctggggactgagaaggttattactgaaatcagtcagacctgggcaaccatgaagttttcttacgaagttcactatcgaacaggcattccattactaaagtctgatgaacaactttttgaaactctagagcacaaccaagttcagttgcagactcttcttcaaagcaagtatgtagaatatttcattgagcaagtgttaagctggcaaaataaattaaacatagcagacttggtcatcttcacttggatggaagtccagcgaacttggtctcacctggaaagcatttttgtctgttcagaagatattcgaatccagcttgtgaaagatgctagaagatttgatggggtggatgctgaatttaaggagttaatgttcaagacagccaaagtagaaaatgtgttagaagcaacgtgcagacctaatctctatgaaaaacttaaagatttacagtccaggctttctctttgtgaaaaagctctcgctgaatacctggaaaccaagcgcatagcctttcctcgcttctatttcgtctcttctgctgatttacttgacattctctcaaaaggagctcagcctaaacaggtaacatgtcaccttgccaaacttttcgacagcattgcagatctgcagtttgaagacaatcaggatgtttctgcacacagggcagttggaatgtacagcaaagaaaaggagtatgtcccattccaagccgagtgtgaatgtgtgggccatgtggaaacatggcttctgcaacttgaacagactatgcaagaaacggtgcgtcattctataacagaagccatagtggcctacgaggaaaaacctagggaactgtggatttttgatttcccagctcaggttgcactaaccagctcacaaatatggtggaccacagatgtaggaatagccttcagtagactggaagaaggctacgaaacagccctgaaggatttccataaaaaacagatttctcagctgaatacactgattacacttttgctgggagaacttccacctggagacagacagaagatcatgacaatttgtaccatagatgtccatgccagagacgtggtggcaaaacttatttctcagaaggttgtcagtccccaagcttttacatggctgtctcaacttcgtcaccgatgggaggatacccagaaacactgctttgttaatatttgtgatgcccagttccagtacttctatgaatacttaggaaacagccctcgactagtgatcactcctctaactgacaggtgttatattaccttaactcaatcacttcatctaaccatgagtggggctcctgctggcccagctggtaccgggaaaacagagaccaccaaagacctaggacgtgcccttggcatgatggtctatgtattcaactgttcagagcaaatggactacaaatccataggcaatatctataagggattggtgcagacaggagcttggggctgctttgatgagttcaaccgaatctctgtggaagttctgtcagtggtggcagtacaagtgaaaatgattcatgatgccatcagaaacaggaagaagagatttgtatttcttggggaagctatcacactgaagccatcagttggaatatttattactatgaacccgggttatgctggtcgaaccgaattaccggaaaatctcaaagctcttttcagaccctgtgccatggtggcccctgacattgagctaatctgtgaaatcttgttagttgctgaaggttttgtggatgcgcgtgcattagcccgaaagttcattacgttgtacacgctttgcaaggagcttctctccaagcaggatcattacgactggggacttcgtgctattaagtctgtcttggttgtggctggatctctgaaacgaggagataaaaatagacccgaagatcaggtactcatgagagcattaagggatttcaatatgcccaaaatagtgactgacgacatcccagtgtttctgggcctggtcggtgacctgtttccagccctggatgtgccccggaggaggaagctgcactttgaacagatggtcaggcagtctaccctggagctccgcctgcagcctgaagagagcttcatcctcaaagttgtccagcttgaggaactgttggctgtgcggcactcggtctttgtagttggaaatgcaggcacaggaaagagtaagattttgagaacactgaaccgaacatatgttaacatgaaacagaagccggtttggaatgacttaaaccctaaagctgtgacaacagatgaactctttggtttcatacatcatgctacccgagaatggaaagatggcaagattgtttactcttattttataggtctcttctcatccattctacgagaacaagcaaatcttaagcatgatggaccaaaatggatagtcctggatggcgatattgaccccatgtggattgaatcactgaatactgtaatggatgataacaaggtgctgaccctcgccagcaatgagcgcattgcactcactcccttcatgaggcttctgtttgagatacatcacttaaggagcgcaaccccggccactgtttccagagctggtattctgtatgtgaacccacaagatctgggctggaatccgtatgtggccagttggatagacagaaggcggcatcaatcagaaaaggccaatttgactattctttttgataaatatgtccctgcatgcttggataaactgagaacaagctttaaaaccatcacttcaattcctgagagtagcctggtgcagactctatgtgttcttttggagtgcttgctgactcctgaaaatgtaccttctgacagcccaaaagaagtttatgaagtctattttgtatttgcttgtatctgggcttttggaggcaccctgctacaagatcagatttctgattatcaagctgacttcagtcggtggtggcagaaagagatgaaagcagtgaaatttccgtcgcagggaacaatctttgattattatgtggaccacaaaactaagaaattattgccctgggctgacaaaattgcccagtttactatggatccagatgtgcctctgcagacagttctcgttcacacaacagagacagctcgtcttagatatttcatggagttgttgcttgagaaaggaaaacctctaatgctagtaggaaatgcaggagtgggaaaaacagtctttgtaggtgacacattggcaagtctctctgaggattacatagtatcccgtgtgcctttcaactactacacgacatccacagctctgcaaaaaattcttgagaaacccctagagaaaaaagctggtcataactatggtcctggaggaaataaaaaattgatttattttatcgacgacatgaacatgcctgaagtggacttatatggcaccgttcagcctcacaccctgatccggcagcatattgattatggacattggtatgatagacagaaggtgatgcttaaagaaatccataactgccagtatgtcgcctgcatgaatccgatggtgggcagcttcaccatcaatcccaggctacagagacatttcacagtgtttgcattcaattttccatctttggatgcactaaacaccatctatggccaaatctttagcttccatttccaacagcaagcatttgctccatcaattctcaggagtggccccactttgatccaggcaacaatagcattccatcagacaatgatgtgtaactttttacccacggctattaaattccactacatctttaatctgagagatttatcaaacgtcttccaggggattttatttgcttctcctgagtgtttaaaaggtccacttgatttaatacatctgtggcttcatgaatctgcccgtgtttatggagacaaactgatagacaaaaaagattgtgatttgtttcagagaagaatgctggaaactgcttataaatattttgaaggtatagatagtcacatgctgcttcaacagcccctcatttattgccactttgctgatagagggaaggacccacattacatgccagtgaaggactgggaagtgctgaagacgattcttacagaaacgttagacaactacaatgaactaaatgctgccatgcacctagttttgtttgaagatgccatgcaacatgtgtgtcgcatcagccggatcttacgaacccctcagggctgtgctctcttggttggagttgggggcagtggcaagcagagcttgtccaggctggcagcttaccttcgtggccttgaggtctttcagatcactctgaccgagggctatggaatccaggaacttcgggtagatcttgccaatttgtacatccgaactggagccaagaacatgcccactgtgttcctgctgacagatgcccaggttctagatgagagcttcctcgtgctgattaatgacttgctggcatcaggagaaatcccagatctgttcagcgatgaagatgtggacaagataatttctggaattcataatgaagttcatgctctgggcatggtagactccagggaaaactgttggaaattctttatggccagggtgcgactacagctcaaaatcattttgtgtttctctccagttggtcgcacgctgagagttagagctcggaagttcccagccatagttaactgcacggctattgactggtttcatgcgtggccgcaggaggctctggtctccgtcagcaggaggttcattgaggaaaccaagggaattgagccagtgcacaaagactctattagccttttcatggcacatgttcacaccactgtaaatgaaatgagtaccagatattaccagaatgagagaagacacaactataccaccccaaagagttttctagaacaaatatcactgtttaagaacctgttgaagaagaagcaaaatgaggtatccgagaaaaaagaacgcctggtgaacggcatccaaaagctaaaaaccacagcctctcaggtgggagatctaaaagccagacttgcctctcaagaagccgagctgcaactgagaaatcatgatgccgaagctctgatcacaaagatcggccttcagacggagaaagtgagccgggaaaagaccatcgctgatgctgaggagcgaaaggtgacagccattcagactgaagtgttccagaaacagagagaatgtgaagctgacttactcaaggctgagcctgcactggtggctgctacagctgcactcaatacactcaacagggtcaacctcagtgagctgaaagcctttcccaaccctcccatcgcagttaccaatgttactgcagccgtgatggtccttctggctcctcggggaagagtgcccaaagaccgaagttggaaagcagctaaagtcttcatgggaaaggttgatgattttttgcaagcattaattaactatgacaaagagcacattccagagaactgtctaaaagtggtgaatgaacactatttgaaagacccagagtttaatccaaacctgattcgaaccaaatcttttgcagcagctggcctgtgtgcctgggtcatcaacatcattaaattctatgaggtctactgtgatgtggagccaaaacgccaagcattagcccaagcaaacttagaactggctgcagctactgaaaaactagaggctatcaggaaaaagcttgtggatctggatcgaaatctgagcagactcacggcttcatttgaaaaagcaacagctgagaaagtccggtgtcaagaagaggtgaaccaaaccaacaaaaccatcaaattagctaacagacttgtcaaggaacttgaggcaaagaagattcgctggggtcaatccattaagtcctttgaagctcaagagaagacactctgtggagatgttcttctcacggcggcatttgtgtcttacgtcggacccttcacaaggcagtatcgccaggagctggtgcactgcaagtgggttccctttcttcaacagaaggtttccattccactaaccgaaggcctggacttgatatccatgttgacggatgatgctacaattgccgcctggaataacgaaggactgcccagtgacagaatgtccaccgaaaatgccgctatcctaacacactgtgagcgctggcctctggtgatagatccccagcaacagggaattaagtggatcaagaataagtatggaatggacctgaaagtcacacatttgggccagaaagggtttttgaatgccattgaaactgctttggcctttggtgatgtcatcttaattgaaaatctcgaggaaacgatagatccagtcctggatccactacttggcaggaacacaattaaaaaaggaaagtatatcaggattggagataaagaatgtgaatttaacaagaactttcgccttatccttcacacaaaattggcaaatcctcactataagccggaattacaagctcagacaactctcctcaatttcacagtcacagaagatggtctagaagcccagctgctggcagaggttgtcagtattgaaaggccagatttggagaaacttaagttggtattgacaaagcaccaaaatgattttaaaattgagctcaagtatctggaagacgatctccttttgcgcctttctgcggcagagggaagctttctggatgacaccaaactggtagagagattggaggcaacaaagaccaccgtggcagagatagagcacaaggtgattgaagccaaagaaaatgaaagaaaaatcaacgaggcccgagaatgttacagaccagtggcagcaagagcatctcttctttattttgttattaatgacctccaaaaaatcaaccccctctaccaattctctttgaaggcttttaacgtgctgttccacagagcgatcgagcaggctgacaaggtggaagacatgcagggacgcatctctatcctgatggagagcatcacccatgctgtcttcctctacaccagccaggcgctgtttgagaaggacaagctcaccttcctgtcccagatggcttttcagattttgttgagaaagaaagagatagaccctcttgaattggatttcctgcttcgattcacagttgaacacactcatctgagtcccgttgacttcctaacttctcagtcatggagtgctatcaaggcaattgccgtcatggaagaatttcgaggcatagaccgagatgtggaaggatctgccaagcagtggaggaagtgggtagaatccgagtgtccagaaaaagaaaaattacctcaagaatggaagaagaaaagtttaatacagaagctgattcttctgagagcaatgcgccctgacagaatgacgtatgctctcagaaattttgtagaggaaaaactgggtgcgaagtatgtggagaggaccagattggacttagttaaagcattcgaagaaagcagcccagccacccccatattcttcatcctgtctccgggggtagatgcccttaaagacctggagattcttggcaaaagacttggctttacaattgactctggaaaattccacaatgtgtctttaggacaaggtcaggagacggtggcagaagtggccctggagaaagcttccaaaggaggacactgggtcatcctccaaaatgttcatttggtagccaagtggctaggaaccttggagaagctccttgaaagattcagccaaggaagccacagagattacagggttttcatgagtgctgagtctgcacctacaccagatgagcatatcatccctcaaggactcctggaaaattccattaagatcactaatgaacccccaacagggatgctggccaatttgcatgccgccctgtacaactttgatcaggatacacttgaaatatgctccaaggagcaggagtttaaaagcatccttttttctctctgctacttccacgcctgtgttgctgggagactgaggtttggcccccagggctggagccgaagctatccttttaatcctggagacctcaccatttgtgccagtgtcctctacaactacttagaggcaaactctaaagtcccatgggaagatctccgttatctctttggtgagatcatgtatggaggccacatcacagatgactgggatcgcaaactgtgtcgggtgtatttagaagaattcatgaatccatctctgactgaagatgaactgatgctggcaccaggttttgctgccccaccctacctagattatgcaggctaccaccagtacatagaggagatgcttcctccagaaagcccggcactgtatggcctccacccaaatgctgaaatagaattcctgacagtgacatccaacactctcttcagaactttgctggagatgcagcccaggaatgcactcagtggtgatgaactggggcagtctacagaagaaaaggttaagaatgtcttggatgacattttggagaaacttccagaagagttcaacatggcagagataatgcaaaaaaattcaaatagaagcccatatgttcttgtttgcttccaagaatgtgagaggatgaatattctcattcgggaaatacgtatatcacttgaacaactggaccttagtttgaagggggaattggcattatctcctgctgtggaagcccagcagtttgcattgagttatgacacggtaccagacacttggagcaaactggcttatccttctacttatggcctagcccagtggttcaatgacctcctcctgcgatgccgagaactcgatacttggacacaagaccttacccttccggctgtcgtgtggctctccggcttcttcaaccctcagtccttcttaactgcaatcatgcagacgatggctcgaaaaaatgagtggcccctggataaaacgcgcttgactgctgatgttaccaaaaaaacaaaggaagattatggacacccgccaagggaaggtgcatacctccacggactcttcatggagggcgcccgctgggacacccaagcaggaaccattgttgaagcccgtctcaaggagctggcatgccctatgccggtcatctttgcaaaagccacccccgtggacagacaagaaaccaaacagacctacgagtgccctgtgtatagaaccaaactgagaggccccagctacatctggaccttcaggctgaagagcgaagagaagactgcaaaatgggttctggctggagtggctctgcttctagaagcgtaaggtaacactggcattcctctagcctctgctggagtgcagtgaggattttctagcatgttgctgcactgttcccatgcacattattctaactttttagtaactcacacgtgcattcttttttcaacgctatccttagagtgaaagtcagaaaaaaatactagaaactaactcagggctgagcgtggtggcacacgactgtaatcccagttactcaggaggtaggagaatcacttgaacctaggaggcaaaggttgcagtgagccgaggttgcaccactgcactccctcctgggcaacagaacaagactccatctcaaaaaaaaaaaagtacatcataaaagtacatcatatgtgaacatgcaaaagcaatgcagccggaaagaacggagattttaatttttaacaaacaacaaattaaattattagcccttaaactctttcaaaatataaaagcagcaggccccaggtgagtcctgaaggaagaggctagcactctgtaaggcctccagtgtccagtgtctacaatgttgatggtccccttttgttcagtcaagttttaataaaaataaaactgttctacagttaa

SEQ ID NO: 128503 - DNA, 524 bp, Homo sapiens
  Payload ID: 5152
  Gene Symbol: DNAH11
  Gene Name: dynein, axonemal, heavy chain 11
  ENST ID: ENST00000605912
  CDS Start-End: 1-524
acagttctcgttcacacaacagagacagctcgtcttagatatttcatggagttgttgcttgagaaaggaaaacctctaatgctagtaggaaatgcaggagtgggaaaaacagtctttgtaggtgacacattggcaagtctctctgaggattacatagtatcccgtgtgcctttcaactactacacgacatccacagctctgcaaaaaattcttgagaaacccctagagaaaaaagctggtcataactatggtcctggaggaaataaaaaattgatttattttatcgacgacatgaacatgcctgaagtggacttatatggcaccgttcagcctcacaccctgatccggcagcatattgattatggacattggtatgatagacagaaggtgatgcttaaagaaatccataactgccagtatgtcgcctgcatgaatccgatggtgggcagcttcaccatcaatcccaggctacagggtatagatagtcacatgctgcttcaacagcccctcatttattgccactt

SEQ ID NO: 128504 - DNA, 13670 bp, Homo sapiens
  Payload ID: 5152
  Gene Symbol: DNAH11
  Gene Name: dynein, axonemal, heavy chain 11
  ENST ID: ENST00000620169
  CDS Start-End: 32-13603
ccggcctcgcgttccctcggacggttgcccaatggcagcccaggtggcagcccgggaggcgcgagacttcagagaagccccgacccttcgcctaacctcgggggccggcctggaggcagtgggcgctgtggagctcgaggaggaggaggagaacgaggaggaggcggcggccaggagagcgcggagtttcgcccaagacgcgcgggtgcgcttcctcggcggccgcctggcgatgatgctggggttcacggaggagaaatggagccagtatttggaaagcgaggacaaccggcaggttcttggggagtttctggaaagcaccagcccggcttgccttgtgtttagcttcgccgcctcggggcgccttgcggcttcccaggagattccaagagatgcaaaccataaacttgtttttatttccaagaagattactgaaagcattggagtaaatgacttttctcaagtggttttatttggagagttacctgcgttgtctcttggacatgtatctgctttccttgatgagattttagtgccagttctttctaataagaacaaccataagtcctggtcctgttttacttcacaagatatggaatatcacatagaagtcatgaaaaagaagatgtatatttttaggggcaaaatgtctagaagaactcttctaccaattcccactgttgcaggaaagatggatctggatcagaattgttcagagaacaagccaccgtcaaacgaaaggataatacttcatgcaattgaatctgtggttattgaatggtcacatcaaatccaagaaattatagaaagagattcagtgcagcgtttgttgaatggtcttcacttgtctcctcaagcagaactagatttctggatgatgaggagagaaaatctgtcatgcatttatgatcaacttcaggcacctgttgtcctcaaaatggttaagatcctgacaactaaacaaagcagctattttcctactctgaaggacatttttctggctgtggaaaatgctcttctcgaagcccaagatgtggaactttacctgagacctctgaggagacacatccagtgtctccaggagacggaattcccacagacacgcatattaatcgctccattatttcataccatctgtctgatctggagtcattccaagttttataacaccccagctcgggttatagttttattgcaagagttttgtaatctcttcattaaccaggcaacagcttacctttcacctgaggaccttttgaggggagaaatagaagagtcactggaaaaggtgcaggtggctgttaacatcttaaagactttcaaaaactcctttttcaactatagaaaaaaattggcaagctactttatgggaagaaagctgagaccatgggatttccagtctcatctggtgttttgcagatttgacaagtttcttgatcgtttaataaaaatagaggatatatttgccaccactttggaatttgaaaagctggaaagactggaatttggtggtaccaaaggagcaattttaaatggacaagtccacgagatgagtgaagaacttatggaactctgtaaactttttaaacagagcacttatgacccatctgattgcactaacatggagtttgaaagtgattatgtggcatttaagtccaaaactctggaatttgacagaaggcttgggacaattatttgtgaagctttctttaactgcaatggcttagaagctgcatttaagcttttgaccatatttggaaattttctagagaagccagttgtcatggaaattttcagcctacattacagcacactagtgcatatgtttaatacagagctggatgtgtgtaagcaactgtataatgaacacatgaaacagattgaatgtggtcatgtagttcttaacaagaacatgccatttacctcaggaaatatgaaatgggcccagcaggttctccaacgacttcaaatgttttggtcaaacttcgcatctctccgttatctatttttgggcaatcctgatcacgctttagtttatcaaaagtatgttgaaatgaccactttgcttgatcaatttgaaagtcgtatctataatgaatggaaaagtaatgtggatgaaatctgtgaattcaatttgaatcaacccttggttaaattcagtgccataaatggtcttctctgtgtcaattttgacccaaagctagtggctgtattgagagaagtgaaatatcttttgatgttgaagaaacaagacataccagattcagctttagccatcttcaagaaaaggaacactattttaaagtacattggaaatcttgaccttcttgtgcaagggtataataaactcaaacagacgctcctggaagttgaataccctctgattgaagatgagctgagggctattgacgagcagctgacagcagccacaacgtggctgacatggcaggatgactgctggggctacatcgagagggtgagggcagccacgtccgagttggagcacagagttgagcgcacacagaaaaacgtgaaggtgatccagcagaccatgaggggctgggccaggtgcgtgctacctcccaggagagagcacagacgagaggcagccttcaccttggaggacaagggtgatttgtttacaaaaaaatacaagttaatccaaggagatggctgcaagatccacaacttggtcgaggaaaataggaagctcttcaaagccaatccctctctggatacctggaaaatttatgtagaattcattgacgacattgtggtggaaggcttttttcaggctataatgcacgacttagacttctttctgaagaatacagagaaacaattgaaaccggcaccgttttttcaagcacaaatgatcttgttgcctcctgagattgtgtttaaaccttccctagacagagaggctggggatggcttctatgatcttgtagaagaaatgttatgcaatagttttagaatgtctgcccagatgaaccgaatagcaacacacctggaaattaaaaattatcagaatgatatggataacatgttaggcctggcagaggtcaggcaggagatcatgaacagagtggtgaatgtcatcaacaaagtcttagatttcagaaacaccctggagacccacacttacctctgggtggatgatcgagctgagtttatgaagcattttctcttgtatggccatgctgtgtcttccgatgaaatggatgctcatgcaaatgaagaaattcccgaacaaccaccaactcttgagcaattcaaagaacagattgacatttatgaagctttgtatgttcaaatgagcaaatttgaggactttagagtgtttgatagttggttcaaggtggacatgaagcctttcaaagtgagcttgttaaccataattaagaaatggagctggatgtttcaggagcatcttttgagatttgtcattgacagtctgaatgagctacaagaatttataaaggagacagattccggacttcagagagaattaaatgaaggtgatcatgatggtttagttgacatcatggtgcatcttctggctgtaagaagccgacagagagctactgatgaactctttgaacctctaaaagaaacgatcaccctcttggaaagctatggccagaagatgcctgagcaggtctatattcagctagaggaattacctgaaagatgggaaactaccaaaaagatcgcagcaactgtcagacatgaagtctcacctctccataatgcggaagtcactcttataaggaaaaaatgtattttgtttgacgcaaagcaggcagagttcagagagagattcagacactatgcccctcttggatttaatgcagaaaatccatacacagcgcttgataaggcaaatgaagagcttgaggccttagaagaagaaatgttgcagatgcaagaatctactcgtctttttgaagtggctcttccagagtacaaacaaatgaaacagtgtcgcaaagaaataaaattgctcaagggactgtgggatgtcattatttatgttcgaagaagcattgataattggactaaaacccagtggagacagattcatgtggaacagatggatgtagaactcagaaggtttgccaaggcgagttccataactgaaatttggtcactcaacaaggaagtccgcgtctgggatgcttacacgggcctggaaggcacagttaaggacatgacagcctccctgagggccatcacagagttacagagccctgccctcagggacaggcattggcaccagctgatgaaagctattggggtcaagtttttaataaatgaagccacaactttggcagatttgttagcactgcggttacacagagtggaagatgatgtccgaaggattgtggacaaggcggtgaaagagctggggactgagaaggttattactgaaatcagtcagacctgggcaaccatgaagttttcttacgaagttcactatcgaacaggcattccattactaaagtctgatgaacaactttttgaaactctagagcacaaccaagttcagttgcagactcttcttcaaagcaagtatgtagaatatttcattgagcaagtgttaagctggcaaaataaattaaacatagcagacttggtcatcttcacttggatggaagtccagcgaacttggtctcacctggaaagcatttttgtctgttcagaagatattcgaatccagcttgtgaaagatgctagaagatttgatggggtggatgctgaatttaaggagttaatgttcaagacagccaaagtagaaaatgtgttagaagcaacgtgcagacctaatctctatgaaaaacttaaagatttacagtccaggctttctctttgtgaaaaagctctcgctgaatacctggaaaccaagcgcatagcctttcctcgcttctatttcgtctcttctgctgatttacttgacattctctcaaaaggagctcagcctaaacaggtaacatgtcaccttgccaaacttttcgacagcattgcagatctgcagtttgaagacaatcaggatgtttctgcacacagggcagttggaatgtacagcaaagaaaaggagtatgtcccattccaagccgagtgtgaatgtgtgggccatgtggaaacatggcttctgcaacttgaacagactatgcaagaaacggtgcgtcattctataacagaagccatagtggcctacgaggaaaaacctagggaactgtggatttttgatttcccagctcaggttgcactaaccagctcacaaatatggtggaccacagatgtaggaatagccttcagtagactggaagaaggctacgaaacagccctgaaggatttccataaaaaacagatttctcagctgaatacactgattacacttttgctgggagaacttccacctggagacagacagaagatcatgacaatttgtaccatagatgtccatgccagagacgtggtggcaaaacttatttctcagaagcaagttgttgtcagtccccaagcttttacatggctgtctcaacttcgtcaccgatgggaggatacccagaaacactgctttgttaatatttgtgatgcccagttccagtacttctatgaatacttaggaaacagccctcgactagtgatcactcctctaactgacaggtgttatattaccttaactcaatcacttcatctaaccatgagtggggctcctgctggcccagctggtaccgggaaaacagagaccaccaaagacctaggacgtgcccttggcatgatggtctatgtattcaactgttcagagcaaatggactacaaatccataggcaatatctataagggattggtgcagacaggagcttggggctgctttgatgagttcaaccgaatctctgtggaagttctgtcagtggtggcagtacaagtgaaaatgattcatgatgccatcagaaacaggaagaagagatttgtatttcttggggaagctatcacactgaagccatcagttggaatatttattactatgaacccgggttatgctggtcgaaccgaattaccggaaaatctcaaagctcttttcagaccctgtgccatggtggcccctgacattgagctaatctgtgaaatcttgttagttgctgaaggttttgtggatgcgcgtgcattagcccgaaagttcattacgttgtacacgctttgcaaggagcttctctccaagcaggatcattacgactggggacttcgtgctattaagtctgtcttggttgtggctggatctctgaaacgaggagataaaaatagacccgaagatcaggtactcatgagagcattaagggatttcaatatgcccaaaatagtgactgacgacatcccagtgtttctgggcctggtcggtgacctgtttccagccctggatgtgccccggaggaggaagctgcactttgaacagatggtcaggcagtctaccctggagctccgcctgcagcctgaagagagcttcatcctcaaagttgtccagcttgaggaactgttggctgtgcggcactcggtctttgtagttggaaatgcaggcacaggaaagagtaagattttgagaacactgaaccgaacatatgttaacatgaaacagaagccggtttggaatgacttaaaccctaaagctgtgacaacagatgaactctttggtttcatacatcatgctacccgagaatggaaagatggcaagattgtttactcttattttataggtctcttctcatccattctacgagaacaagcaaatcttaagcatgatggaccaaaatggatagtcctggatggcgatattgaccccatgtggattgaatcactgaatactgtaatggatgataacaaggtgctgaccctcgccagcaatgagcgcattgcactcactcccttcatgaggcttctgtttgagatacatcacttaaggagcgcaaccccggccactgtttccagagctggtattctgtatgtgaacccacaagatctgggctggaatccgtatgtggccagttggatagacagaaggcggcatcaatcagaaaaggccaatttgactattctttttgataaatatgtccctgcatgcttggataaactgagaacaagctttaaaaccatcacttcaattcctgagagtagcctggtgcagactctatgtgttcttttggagtgcttgctgactcctgaaaatgtaccttctgacagcccaaaagaagtttatgaagtctattttgtatttgcttgtatctgggcttttggaggcaccctgctacaagatcagatttctgattatcaagctgacttcagtcggtggtggcagaaagagatgaaagcagtgaaatttccgtcgcagggaacaatctttgattattatgtggaccacaaaactaagaaattattgccctgggctgacaaaattgcccagtttactatggatccagatgtgcctctgcagacagttctcgttcacacaacagagacagctcgtcttagatatttcatggagttgttgcttgagaaaggaaaacctctaatgctagtaggaaatgcaggagtgggaaaaacagtctttgtaggtgacacattggcaagtctctctgaggattacatagtatcccgtgtgcctttcaactactacacgacatccacagctctgcaaaaaattcttgagaaacccctagagaaaaaagctggtcataactatggtcctggaggaaataaaaaattgatttattttatcgacgacatgaacatgcctgaagtggacttatatggcaccgttcagcctcacaccctgatccggcagcatattgattatggacattggtatgatagacagaaggtgatgcttaaagaaatccataactgccagtatgtcgcctgcatgaatccgatggtgggcagcttcaccatcaatcccaggctacagagacatttcacagtgtttgcattcaattttccatctttggatgcactaaacaccatctatggccaaatctttagcttccatttccaacagcaagcatttgctccatcaattctcaggagtggccccactttgatccaggcaacaatagcattccatcagacaatgatgtgtaactttttacccacggctattaaattccactacatctttaatctgagagatttatcaaacgtcttccaggggattttatttgcttctcctgagtgtttaaaaggtccacttgatttaatacatctgtggcttcatgaatctgcccgtgtttatggagacaaactgatagacaaaaaagattgtgatttgtttcagagaagaatgctggaaactgcttataaatattttgaaggtatagatagtcacatgctgcttcaacagcccctcatttattgccactttgctgatagagggaaggacccacattacatgccagtgaaggactgggaagtgctgaagacgattcttacagaaacgttagacaactacaatgaactaaatgctgccatgcacctagttttgtttgaagatgccatgcaacatgtgtgtcgcatcagccggatcttacgaacccctcagggctgtgctctcttggttggagttgggggcagtggcaagcagagcttgtccaggctggcagcttaccttcgtggccttgaggtctttcagatcactctgaccgagggctatggaatccaggaacttcgggtagatcttgccaatttgtacatccgaactggagccaagaacatgcccactgtgttcctgctgacagatgcccaggttctagatgagagcttcctcgtgctgattaatgacttgctggcatcaggagaaatcccagatctgttcagcgatgaagatgtggacaagataatttctggaattcataatgaagttcatgctctgggcatggtagactccagggaaaactgttggaaattctttatggccagggtgcgactacagctcaaaatcattttgtgtttctctccagttggtcgcacgctgagagttagagctcggaagttcccagccatagttaactgcacggctattgactggtttcatgcgtggccgcaggaggctctggtctccgtcagcaggaggttcattgaggaaaccaagggaattgagccagtgcacaaagactctattagccttttcatggcacatgttcacaccactgtaaatgaaatgagtaccagatattaccagaatgagagaagacacaactataccaccccaaagagttttctagaacaaatatcactgtttaagaacctgttgaagaagaagcaaaatgaggtatccgagaaaaaagaacgcctggtgaacggcatccaaaagctaaaaaccacagcctctcaggtgggagatctaaaagccagacttgcctctcaagaagccgagctgcaactgagaaatcatgatgccgaagctctgatcacaaagatcggccttcagacggagaaagtgagccgggaaaagaccatcgctgatgctgaggagcgaaaggtgacagccattcagactgaagtgttccagaaacagagagaatgtgaagctgacttactcaaggctgagcctgcactggtggctgctacagctgcactcaatacactcaacagggtcaacctcagtgagctgaaagcctttcccaaccctcccatcgcagttaccaatgttactgcagccgtgatggtccttctggctcctcggggaagagtgcccaaagaccgaagttggaaagcagctaaagtcttcatgggaaaggttgatgattttttgcaagcattaattaactatgacaaagagcacattccagagaactgtctaaaagtggtgaatgaacactatttgaaagacccagagtttaatccaaacctgattcgaaccaaatcttttgcagcagctggcctgtgtgcctgggtcatcaacatcattaaattctatgaggtctactgtgatgtggagccaaaacgccaagcattagcccaagcaaacttagaactggctgcagctactgaaaaactagaggctatcaggaaaaagcttgtggatctggatcgaaatctgagcagactcacggcttcatttgaaaaagcaacagctgagaaagtccggtgtcaagaagaggtgaaccaaaccaacaaaaccatcaaattagctaacagacttgtcaaggaacttgaggcaaagaagattcgctggggtcaatccattaagtcctttgaagctcaagagaagacactctgtggagatgttcttctcacggcggcatttgtgtcttacgtcggacccttcacaaggcagtatcgccaggagctggtgcactgcaagtgggttccctttcttcaacagaaggtttccattccactaaccgaaggcctggacttgatatccatgttgacggatgatgctacaattgccgcctggaataacgaaggactgcccagtgacagaatgtccaccgaaaatgccgctatcctaacacactgtgagcgctggcctctggtgatagatccccagcaacagggaattaagtggatcaagaataagtatggaatggacctgaaagtcacacatttgggccagaaagggtttttgaatgccattgaaactgctttggcctttggtgatgtcatcttaattgaaaatctcgaggaaacgatagatccagtcctggatccactacttggcaggaacacaattaaaaaaggaaagtatatcaggattggagataaagaatgtgaatttaacaagaactttcgccttatccttcacacaaaattggcaaatcctcactataagccggaattacaagctcagacaactctcctcaatttcacagtcacagaagatggtctagaagcccagctgctggcagaggttgtcagtattgaaaggccagatttggagaaacttaagttggtattgacaaagcaccaaaatgattttaaaattgagctcaagtatctggaagacgatctccttttgcgcctttctgcggcagagggaagctttctggatgacaccaaactggtagagagattggaggcaacaaagaccaccgtggcagagatagagcacaaggtgattgaagccaaagaaaatgaaagaaaaatcaacgaggcccgagaatgttacagaccagtggcagcaagagcatctcttctttattttgttattaatgacctccaaaaaatcaaccccctctaccaattctctttgaaggcttttaacgtgctgttccacagagcgatcgagcaggctgacaaggtggaagacatgcagggacgcatctctatcctgatggagagcatcacccatgctgtcttcctctacaccagccaggcgctgtttgagaaggacaagctcaccttcctgtcccagatggcttttcagattttgttgagaaagaaagagatagaccctcttgaattggatttcctgcttcgattcacagttgaacacactcatctgagtcccgttgacttcctaacttctcagtcatggagtgctatcaaggcaattgccgtcatggaagaatttcgaggcatagaccgagatgtggaaggatctgccaagcagtggaggaagtgggtagaatccgagtgtccagaaaaagaaaaattacctcaagaatggaagaagaaaagtttaatacagaagctgattcttctgagagcaatgcgccctgacagaatgacgtatgctctcagaaattttgtagaggaaaaactgggtgcgaagtatgtggagaggaccagattggacttagttaaagcattcgaagaaagcagcccagccacccccatattcttcatcctgtctccgggggtagatgcccttaaagacctggagattcttggcaaaagacttggctttacaattgactctggaaaattccacaatgtgtctttaggacaaggtcaggagacggtggcagaagtggccctggagaaagcttccaaaggaggacactgggtcatcctccaaaatgttcatttggtagccaagtggctaggaaccttggagaagctccttgaaagattcagccaaggaagccacagagattacagggttttcatgagtgctgagtctgcacctacaccagatgagcatatcatccctcaaggactcctggaaaattccattaagatcactaatgaacccccaacagggatgctggccaatttgcatgccgccctgtacaactttgatcaggatacacttgaaatatgctccaaggagcaggagtttaaaagcatccttttttctctctgctacttccacgcctgtgttgctgggagactgaggtttggcccccagggctggagccgaagctatccttttaatcctggagacctcaccatttgtgccagtgtcctctacaactacttagaggcaaactctaaagtcccatgggaagatctccgttatctctttggtgagatcatgtatggaggccacatcacagatgactgggatcgcaaactgtgtcgggtgtatttagaagaattcatgaatccatctctgactgaagatgaactgatgctggcaccaggttttgctgccccaccctacctagattatgcaggctaccaccagtacatagaggagatgcttcctccagaaagcccggcactgtatggcctccacccaaatgctgaaatagaattcctgacagtgacatccaacactctcttcagaactttgctggagatgcagcccaggaatgcactcagtggtgatgaactggggcagtctacagaagaaaaggttaagaatgtcttggatgacattttggagaaacttccagaagagttcaacatggcagagataatgcaaaaaaattcaaatagaagcccatatgttcttgtttgcttccaagaatgtgagaggatgaatattctcattcgggaaatacgtatatcacttgaacaactggaccttagtttgaagggggaattggcattatctcctgctgtggaagcccagcagtttgcattgagttatgacacggtaccagacacttggagcaaactggcttatccttctacttatggcctagcccagtggttcaatgacctcctcctgcgatgccgagaactcgatacttggacacaagaccttacccttccggctgtcgtgtggctctccggcttcttcaaccctcagtccttcttaactgcaatcatgcagacgatggctcgaaaaaatgagtggcccctggataaaacgcgcttgactgctgatgttaccaaaaaaacaaaggaagattatggacacccgccaagggaaggtgcatacctccacggactcttcatggagggcgcccgctgggacacccaagcaggaaccattgttgaagcccgtctcaaggagctggcatgccctatgccggtcatctttgcaaaagccacccccgtggacagacaagaaaccaaacagacctacgagtgccctgtgtatagaaccaaactgagaggccccagctacatctggaccttcaggctgaagagcgaagagaagactgcaaaatgggttctggctggagtggctctgcttctagaagcgtaaggtaacactggcattcctctagcctctgctggagtgcagtgaggattttctagcatgttgctgcact

SEQ ID NO: 128505 - DNA, 9542 bp, Homo sapiens
  Payload ID: 5153
  Gene Symbol: DNAH12
  Gene Name: dynein, axonemal, heavy chain 12
  Uniprot ID: Q6ZR08
  ENST ID: ENST00000351747
  CDS Start-End: 182-9460
gcccttctccagctactcgtttgagagccggtggcgttccggaggtttctccctcgttatccccctgcctttcacctgaggagaggctctgactgtctctctctctctctggcgtctgcgcagcggggaagtagtgagaaacaatcagagtacagagtattttaatctttaggggatcaagatgtcagatgcaaacaaagctgccattgcagcagaaaaggaagctctgaacttgaagttaccccccattgtccatctcccagaaaacataggcgttgatacaccaacacaaagtaagctgctaaaatacagaagatccaaggagcagcagcagaaaattaatcagttagtaattgatggagccaaaagaaatttagacagaacactgggtaaaagaacacctctattaccaccacctgattatcctcaaactatgaccagtgaaatgaaaaaaaaaggattcaactatatttatatgaagcaatgtgtagaaagtagtcctttagtacctattcagcaggaatggctggatcacatgttaaggctgatacctgagtctttaaaggaagggaaagaaagagaagaacttcttgaaagtctcataaatgaggtgtcaagtgactttgaaaacagcatgaagagatatttggtgcagagcgttcttgtgaaaccaccagttaaatcgcttgaagatgaaggaggtcctttacctgaatctcctgtaggcctagattattctaatccttggcattctagctatgtgcaggcaagaaatcaaatattctctaatttgcacattattcatccaactatgaaaatgttactggaccttggttatacaacatttgctgatacagttttgttggacttcacaggaattagagctaaaggtccaattgactgtgaatcactgaaaactgatctatcaatacaaactagaaacgcagaagagaagataatgaatacatggtatccaaaggttataaatctctttaccaagaaggaggcactagaaggtgttaaacctgaaaaattggatgcattttatagctgtgtttccacacttatgtcaaatcagctaaaggatctattaaggagaactgtagaaggatttgtaaaactctttgacccaaaagatcaacaaaggctgccaatatttaagatagaattgacatttgatgacgacaaaatggaattttatcctacctttcaagatttggaagataatgtcttgagtttggtggaacgaatagccgaagctctgcagaatgtccaaacaatcccctcttggctatcaggaacttcaacaccagtaaatcttgacacagaacttcctgaacacgtgttacactgggctgttgatacactgaaggcagcagtacatcggaacttagaaggtgcaagaaagcattatgagacatatgttgaaaaatataattggctccttgatgggactgcagttgagaatatagagacttttcagacagaagatcatacttttgatgaatatacagagtttatagaaaaatttctcagtcttgcctcagaaataatgcttttgcctcagtggattcattacactatggtgcgtttggattgtgaagatttgaagacaggcctgacaaataaagcaaaagcctttgcaaacatattattaaatgacatagcttcaaaatatagaaaagaaaatgaatgtatttgcagtgaatttgaagcaattaaagaacatgcattaaaagtccctgaaacaacagaagagatgatggatctgatatcttatgtagaaaaagcccggactgtaggaatcgaagagttgattttaaggatccaggaatctaaacgccaaatgagttactttttagatgttttcctatttcctcaagaagacttagctttaaatgcaactgtcctcatgtggcctaggaaaattaatcccatctttgatgaaaatgatgagctaattgagaatgctaaacataaaaaagaaaatgaactaatggccaagagagagaaacttattttggaaatagaaaaagaatcacgccgcatggaggagtttacagaatttgcagagctggagcgcatgcaacagtatgtgacagatgtaagacaactacaaaaacgtattcaggaatctgaagaagcagtgcagtttattaataaagaagaggaacttttcaagtgggaattgacaaaatatcctgaactggataaattaaaagttaacattgagccctatcagaagttttttaattttgttttgaagtggcagcgatcagaaaaacggtggatggatggagggtttttggacctcaatggggaaagcatggaggctgatgtggaagagttttcccgagaaatttttaagacactaaaatttttccaaacgaagctaaagaaagaattacaagaaaaaagaaaggcagcaagaaaacggtctttggaagaagagaaaattgaagaagaaccaaaagacaatgctactattactatgtgcagaatgagagctcgtcactggaaacagatatcagaaattgtaggctatgacttgactccagactctggaactacactgagaaaagttttaaaattaaaccttaccccatacttggaacaatttgaagtgataagtgcaggtgcaagcaaggaattttcattagagaaagccatgaatacaatgataggaacttgggaagatattgcttttcatataagtctgtatcgtgacactggagtctgtattctttcttcggtggatgagattcaggccatccttgatgatcaaattataaaaactcagacaatgagaggctcacctttcatcaaaccatttgaacatgagatcaaggcctgggaggaccgcttgattcgaatacaagaaacaattgatgaatggttaaaagtacaagctcaatggctgtacttagagcccatcttttgttctgaggatatcatgcaacagatgccagaagaagggcgtcaatttcagacagtagacagacactggagagatatcatgaagttttgtgctaaagatccaaaggttcttgctgccacttctttaacaggtttattggaaaaactacagaactgcaatgaacttttggagaaaattatgaaaggtcttaacgcatatcttgaaaagaaacgtcttttcttccctcgttttttcttcttatctaatgatgaaatgttagagattttatcagagaccaaagatccacttagagttcagccacatttaaaaaaatgctttgagggcattgctaaattagagttccttcccaatttggacattaaagccatgtatagctctgagggcgagcgagtggagctgattgcactcatttccacgtctgcagcgcggggtgctgtggaaaagtggctcattcaagtggaagacctaatgctccggagtgttcacgatgtgatcgctgcagccaggctggcttatccagaatctgcaagaagagactgggttcgagagtggcctggccaagttgtactttgtatttctcaaatgttctggacatctgagacacaggaagtgataagtggcgggacggagggattaaagaagtattataaggaacttcagaaccaactgaatgagattgtagagctggtaagaggaaagttgtctaagcagaccaggaccactctgggggctttggttactattgatgtccatgctagagatgtggtcatggacatgattaaaatgggtgtctcacatgatacagatttcctgtggcttgctcagctccgatattattgggaaaatgagaatgcccgagttcgtatcattaattgcaatgtaaaatatgcttatgaatatcttggtaactcacctcgacttgtcattacgcctctaactgacaggtgttacagaacattgataggtgctttctatttaaaccttggaggtgctccagaggggccagcaggcacaggaaaaaccgaaaccaccaaggacttggctaaagctcttgctgtacagtgtgtggtgttcaactgttctgatgggctagattatctagcaatgggaaagttttttaaaggactggcttcttctggtgcttgggcttgctttgatgaattcaatcgaattgagttggaagtgttgtcagtggtagctcaacagatcctttgcattcagagagctattcaacagaagttggttgtgtttgtttttgaagggacagaacttaagctcaatccgaattgttttgtagctattaccatgaatcctggctatgcaggacgctctgaattgccggacaatcttaaggttctttttagaacagtggctatgatggttccaaactatgcgcttatagcagaaatctccctctactcttacggatttttgaatgcaagacctctgtctgtgaaaatagtaatgacctataggctttgctcagagcagctctcatcgcaatttcattacgactatggaatgcgagcagtaaaagccgttttagtggctgctggcaatctaaaactaaaatacccaaatgaaaatgaagatatacttcttcttcgatcaattaaagatgtaaatgaaccaaagtttttatcacatgatatacctttatttaatggaataactagtgacttatttcctggtattaaacttcctgaagctgactatcacgaatttttggaatgtgctcatgaagcctgcaatgtacataatcttcagcctgttaaattttttcttgaaaaaataattcaaacatatgaaatgatgattgttagacatggttttatgttagtaggagagccttttgctgctaagacaaaagttctgcatgtgctggcggatacgctaactttaatgaatgaacatggctatggagaggaagaaaaggtcatttatagaactgtaaaccccaaatctattactatgggccaactttttggacagtttgacccagtgtctcatgagtggactgatggtattgtggctaacacttttagagaatttgccttatcagaaacacctgaccggaaatgggttgtatttgatggtcctattgacactttgtggatagagagcatgaacacagtattggatgataataaaaagctttgccttatgagtggagaaatcattcagatgtccccccaaatgagcctcatctttgaaacaatggacctttcccaggcatcccctgccactgtaagtcgttgtggtatgatttatttggagccttcacagttaggatgggaaccacttgtgtcttcttggttgaattcactgaaaggacctctgtgtgaaccagaatatcaagctcttctgagaggactttttgcctggttaataccaccctctttaaaccagcgggttgaattattccagctaaactatttgtatacaaccatagtgtctaaaattttaaaaattctaattactttccgtatttcaaattattttaaatatgtgcctctaaaaactcaatgtacatttattaaattttttctccaccaacaggcttgctttatattctctttgatttggtcgattggaggaagttgtgatacagatggccgtcgtgtttttgatactttcatacgattaatcatactgggaaaagatgatgaaaacccagtgccagattctgtgggtaaatgggaatgcccatttgatgaaaaaggcctggtctatgactacatgtatgagttgaaaaacaaaggtcgctgggtccattggaatgaattaattaaaaatactaatttaggagataaacaaatcaagattcaagatatcatagtccctacgatggacacaattagatatacgtttctaatggatttgagtattacctatgcaaagccactcctttttgtgggtccaacgggtacaggaaaatctgtgtatgtgaaggataagctaatgaatcacttggaaaaggaccagtactttcctttttatattaacttatctgcacggaccagcgccaatcaggttcagaacattatcatggctagattggataaaagacgcaaaggagtctttggaccacctatgggaaagaagtgtataatttttatagatgatatgaatatgcctgcattggagaagtatggagctcaaccacctattgaattattacgacagttttttgactgtggacattggtacgaccttaaggacacaagtaaaatcacgctggtggacatagagctgattgctgcaatgggccctccaggtggtggaagaaatccagttactccccgttgtattcgacatttcaacatctgcagtattaattcttttagtgatgaaactatggtccgaatcttctcatctattgtagcattctaccttagaactcatgaatttcctccagagtactttgtaattgggaaccagatagtcaatgggactatggagatatataaacaatctgtggaaaatcttttacccactcccacaaaatcccattatactttcaacttgcgtgatttttcacgcgtcatccggggctgtttactcattgaaagagacgccgtggcgaacaaacacactatgatccgtctgtttgtgcatgaggttctccgagtgttttatgatcgcctcattaatgatgatgatcgaagatggctgttccagttaactaaaactgttataaaggaccattttaaagaatcatttcacagtatcttttcacatttgaggaaacaaaatgcaccagtaactgaagaagacttaagaaatctcatgtttggtgattatatgaatcctgaccttgaaggagatgatagagtttatattgaaattccaaatattcatcattttagtgatgttgtggaccagtgcttagatgagtataatcaaacacacaaaacaagaatgaatcttgtcatttttaggtatgttttggaacatttatcaagaatatgtcgagttctaaagcaatctggtggaaatgctttgcttgttggtcttggaggaagtggtcgtcaatctttaactcgtctggctacatccatggcaaaaatgcatattttccaaccagaaatttctaagagctatggtatgaatgaatggagagaggatatgaagagctttattgctgtcccggtgaccaacaggatagtggataacaaatccaagattttggaaaagcgcctacgatatttaaatgaccacttcacatacaacttatattgtaatatatgccgatcactatttgagaaggacaagctgttattttcctttttattatgtgccaatcttcttctggcaaggaaagagattgaataccaggaactgatgtttcttttaactggaggagtaagtcttaaaagtgctgagaaaaatcctgatccaacttggctacaggacaaaagctgggaggaaatctgtcgggcaagtgaatttcctgccttcagaggactcaggcaacatttttgtgaacatatatatgaatggcgagaaatctatgacagtaaagagccacataatgctaaatttccagcaccaatggataagaacctaaatgaactacagaaaataataattcttcggtgtttaagacctgataagataaccccagctataacaaactatgtaactgacaaactagggaaaaagtttgtagagcctccaccatttgatttgacaaagagttacttggattcaaattgcaccattcccttaatttttgttctatctccaggagcagatcctatggccagcctgctgaaatttgcaaatgataaatctatgtctggaaataagtttcaagctatttcactgggacagggacaaggaccgattgcagcaaaaatgattaaagcagcaattgaagaaggaacttgggtgtgcctacagaattgccatcttgcagtgtcctggatgcccatgttggaaaaaatatgtgaagattttacctctgaaacctgtaactcatcctttaggctttggctgacaagctatccatcttcaaaattcccagtaacaattctacagaatggagtaaaaatgactaatgaacctcccacgggtcttcggctgaatctccttcaatcatatctcactgatccagtttctgatcctgagtttttcaagggatgccgtggaaaggaactggcctgggagaagttactgtttggagtttgtttttttcatgcccttgtgcaagagagaaagaaatttggtcctcttggttggaatattccatatggatttaatgaatctgacttgcgcatcagtatccgacaactgcagttatttatcaatgaatatgatacaattccatttgaagctatatcttacctgactggggagtgtaattatggaggaagagtgacagacgattgggacagacgtcttctattaaccatgctggctgacttttataatctgtacatagttgaaaaccctcattataagttttctcccagtggaaactattttgcacctcctaaaggcacttatgaggactacattgaattcattaagaaacttccatttactcaacaccctgagatatttggattacatgaaaacgttgacatctccaaggatcttcaacaaacaaaaaccctctttgagtccttgctcctcacccagggaggctccaaacagacaggagcctcaggaagtactgatcagattctgttagaaattaccaaagatatcctcaacaagctccctagtgatttcgacattgaaatggcactacggaagtatcctgtgagatatgaagaaagcatgaatactgtgttagtacaagaaatggaaagatttaacaatttaattataactatacgtaacactctacgggaccttgaaaaagctattaagggtgtggttgtgatggattctgcattggaggcactctccggtagcttacttgttggaaaggttccagaaatatgggccaaacgttcatacccaagccttaagcccctgggaagttacatcacagatttcctagcccggttgaactttttacaggactggtataattcaggaaaaccttgtgtgttttggctgtcaggtttctttttcactcaggcctttttaactggagctatgcagaattatgccagaaaatataccacccctattgatttgctaggatatgaatttgaggttatcccatctgatacatctgacacatcaccagaagatggtgtttatatccacggactgtatctcgatggcgcacgctgggaccgagaaagtggattgcttgctgaacaatatcccaaacttctgtttgacctgatgcccatcatatggataaaaccaactcaaaaatctcggattataaagtcggatgcctatgtctgtcccctctacaagacaagtgaacgtaaaggaactctttccactacgggacattctactaactttgtcattgcaatgttgttaaaaacagaccaacctactcggcactggatcaagcgcggggttgctttgctttgtcagttggatgactaaattggacaaatttataaaacatccaaaagtttaaaaaaaaaaaaacctgtcctacttaaaatatatacattataaaaccaag

SEQ ID NO: 128506 - DNA, 1555 bp, Homo sapiens
  Payload ID: 5153
  Gene Symbol: DNAH12
  Gene Name: dynein, axonemal, heavy chain 12
  Uniprot ID: Q6ZR08
  ENST ID: ENST00000311202
  CDS Start-End: 182-1555
gcccttctccagctactcgtttgagagccggtggcgttccggaggtttctccctcgttatccccctgcctttcacctgaggagaggctctgactgtctctctctctctctggcgtctgcgcagcggggaagtagtgagaaacaatcagagtacagagtattttaatctttaggggatcaagatgtcagatgcaaacaaagctgccattgcagcagaaaaggaagctctgaacttgaagttaccccccattgtccatctcccagaaaacataggcgttgatacaccaacacaaagtaagctgctaaaatacagaagatccaaggagcagcagcagaaaattaatcagttagtaattgatggagccaaaagaaatttagacagaacactgggtaaaagaacacctctattaccaccacctgattatcctcaaactatgaccagtgaaatgaaaaaaaaaggattcaactatatttatatgaagcaatgtgtagaaagtagtcctttagtacctattcagcaggaatggctggatcacatgttaaggctgatacctgagtctttaaaggaagggaaagaaagagaagaacttcttgaaagtctcataaatgaggtgtcaagtgactttgaaaacagcatgaagagatatttggtgcagagcgttcttgtgaaaccaccagttaaatcgcttgaagatgaaggaggtcctttacctgaatctcctgtaggcctagattattctaatccttggcattctagctatgtgcaggcaagaaatcaaatattctctaatttgcacattattcatccaactatgaaaatgttactggaccttggttatacaacatttgctgatacagttttgttggacttcacaggaattagagctaaaggtccaattgactgtgaatcactgaaaactgatctatcaatacaaactagaaacgcagaagagaagataatgaatacatggtatccaaaggttataaatctctttaccaagaaggaggcactagaaggtgttaaacctgaaaaattggatgcattttatagctgtgtttccacacttatgtcaaatcagctaaaggatctattaaggagaactgtagaaggatttgtaaaactctttgacccaaaagatcaacaaaggctgccaatatttaagatagaattgacatttgatgacgacaaaatggaattttatcctacctttcaagatttggaagataatgtcttgagtttggtggaacgaatagccgaagctctgcagaatgtccaaacaatcccctcttggctatcaggaacttcaacaccagtaaatcttgacacagaacttcctgaacacgtgttacactgggctgttgatacactgaaggcagcagtacatcggaacttagaaggtgcaagaaagcattatgagacatatgttgaaaaatataattggctccttgatgggactgcagttgagaatatagagacttttcagacagaagatcatacttttgatgaatatacagaggagctggattgctgggtggtatgggaagtgtatttttaa

SEQ ID NO: 128507 - DNA, 2613 bp, Homo sapiens
  Payload ID: 5153
  Gene Symbol: DNAH12
  Gene Name: dynein, axonemal, heavy chain 12
  ENST ID: ENST00000389536
  CDS Start-End: 182-2536
gcccttctccagctactcgtttgagagccggtggcgttccggaggtttctccctcgttatccccctgcctttcacctgaggagaggctctgactgtctctctctctctctggcgtctgcgcagcggggaagtagtgagaaacaatcagagtacagagtattttaatctttaggggatcaagatgtcagatgcaaacaaagctgccattgcagcagaaaaggaagctctgaacttgaagttaccccccattgtccatctcccagaaaacataggcgttgatacaccaacacaaagtaagctgctaaaatacagaagatccaaggagcagcagcagaaaattaatcagttagtaattgatggagccaaaagaaatttagacagaacactgggtaaaagaacacctctattaccaccacctgattatcctcaaactatgaccagtgaaatgaaaaaaaaaggattcaactatatttatatgaagcaatgtgtagaaagtagtcctttagtacctattcagcaggaatggctggatcacatgttaaggctgatacctgagtctttaaaggaagggaaagaaagagaagaacttcttgaaagtctcataaatgaggtgtcaagtgactttgaaaacagcatgaagagatatttggtgcagagcgttcttgtgaaaccaccagttaaatcgcttgaagatgaaggaggtcctttacctgaatctcctgtaggcctagattattctaatccttggcattctagctatgtgcaggcaagaaatcaaatattctctaatttgcacattattcatccaactatgaaaatgttactggaccttggttatacaacatttgctgatacagttttgttggacttcacaggaattagagctaaaggtccaattgactgtgaatcactgaaaactgatctatcaatacaaactagaaacgcagaagagaagataatgaatacatggtatccaaaggttataaatctctttaccaagaaggaggcactagaaggtgttaaacctgaaaaattggatgcattttatagctgtgtttccacacttatgtcaaatcagctaaaggatctattaaggagaactgtagaaggatttgtaaaactctttgacccaaaagatcaacaaaggctgccaatatttaagatagaattgacatttgatgacgacaaaatggaattttatcctacctttcaagatttggaagataatgtcttgagtttggtggaacgaatagccgaagctctgcagaatgtccaaacaatcccctcttggctatcaggaacttcaacaccagtaaatcttgacacagaacttcctgaacacgtgttacactgggctgttgatacactgaaggcagcagtacatcggaacttagaaggtgcaagaaagcattatgagacatatgttgaaaaatataattggctccttgatgggactgcagttgagaatatagagacttttcagacagaagatcatacttttgatgaatatacagagtttatagaaaaatttctcagtcttgcctcagaaataatgcttttgcctcagtggattcattacactatggtgcgtttggattgtgaagatttgaagacaggcctgacaaataaagcaaaagcctttgcaaacatattattaaatgacatagcttcaaaatatagaaaagaaaatgaatgtatttgcagtgaatttgaagcaattaaagaacatgcattaaaagtccctgaaacaacagaagagatgatggatctgatatcttatgtagaaaaagcccggactgtaggaatcgaagagttgattttaaggatccaggaatctaaacgccaaatgagttactttttagatgttttcctatttcctcaagaagacttagctttaaatgcaactgtcctcatgtggcctaggaaaattaatcccatctttgatgaaaatgatgagctaattgagaatgctaaacataaaaaagaaaatgaactaatggccaagagagagaaacttattttggaaatagaaaaagaatcacgccgcatggaggagtttacagaatttgcagagctggagcgcatgcaacagtatgtgacagatgtaagacaactacaaaaacgtattcaggaatctgaagaagcagtgcagtttattaataaagaagaggaacttttcaagtgggaattgacaaaatatcctgaactggataaattaaaagttaacattgagccctatcagaagttttttaattttgttttgaagtggcagcgatcagaaaaacggtggatggatggagggtttttggacctcaatggggaaagcatggaggctgatgtggaagagttttcccgagaaatttttaagacactaaaatttttccaaacgaagctaaagaaagaattacaagaaaaaagaaaggcagcaagaaaacggtctttggaagaagagaaaattgaagaagaaccaaaagacaatgctactattactatgtgcagtacagtcatggaacagataaaagcttttaaggtataaatatatataataacattttaatattatagctatcttctcaacttttctgttacctaatatataaattataaagccta

SEQ ID NO: 128508 - DNA, 12146 bp, Homo sapiens
  Payload ID: 5153
  Gene Symbol: DNAH12
  Gene Name: dynein, axonemal, heavy chain 12
  ENST ID: ENST00000495027
  CDS Start-End: 182-12064
gcccttctccagctactcgtttgagagccggtggcgttccggaggtttctccctcgttatccccctgcctttcacctgaggagaggctctgactgtctctctctctctctggcgtctgcgcagcggggaagtagtgagaaacaatcagagtacagagtattttaatctttaggggatcaagatgtcagatgcaaacaaagctgccattgcagcagaaaaggaagctctgaacttgaagttaccccccattgtccatctcccagaaaacataggcgttgatacaccaacacaaagtaagctgctaaaatacagaagatccaaggagcagcagcagaaaattaatcagttagtaattgatggagccaaaagaaatttagacagaacactgggtaaaagaacacctctattaccaccacctgattatcctcaaactatgaccagtgaaatgaaaaaaaaaggattcaactatatttatatgaagcaatgtgtagaaagtagtcctttagtacctattcagcaggaatggctggatcacatgttaaggctgatacctgagtctttaaaggaagggaaagaaagagaagaacttcttgaaagtctcataaatgaggtgtcaagtgactttgaaaacagcatgaagagatatttggtgcagagcgttcttgtgaaaccaccagttaaatcgcttgaagatgaaggaggtcctttacctgaatctcctgtaggcctagattattctaatccttggcattctagctatgtgcaggcaagaaatcaaatattctctaatttgcacattattcatccaactatgaaaatgttactggaccttggttatacaacatttgctgatacagttttgttggacttcacaggaattagagctaaaggtccaattgactgtgaatcactgaaaactgatctatcaatacaaactagaaacgcagaagagaagataatgaatacatggtatccaaaggttataaatctctttaccaagaaggaggcactagaaggtgttaaacctgaaaaattggatgcattttatagctgtgtttccacacttatgtcaaatcagctaaaggatctattaaggagaactgtagaaggatttgtaaaactctttgacccaaaagatcaacaaaggctgccaatatttaagatagaattgacatttgatgacgacaaaatggaattttatcctacctttcaagatttggaagataatgtcttgagtttggtggaacgaatagccgaagctctgcagaatgtccaaacaatcccctcttggctatcaggaacttcaacaccagtaaatcttgacacagaacttcctgaacacgtgttacactgggctgttgatacactgaaggcagcagtacatcggaacttagaaggtgcaagaaagcattatgagacatatgttgaaaaatataattggctccttgatgggactgcagttgagaatatagagacttttcagacagaagatcatacttttgatgaatatacagagtttatagaaaaatttctcagtcttgcctcagaaataatgcttttgcctcagtggattcattacactatggtgcgtttggattgtgaagatttgaagacaggcctgacaaataaagcaaaagcctttgcaaacatattattaaatgacatagcttcaaaatatagaaaagaaaatgaatgtatttgcagtgaatttgaagcaattaaagaacatgcattaaaagtccctgaaacaacagaagagatgatggatctgatatcttatgtagaaaaagcccggactgtaggaatcgaagagttgattttaaggatccaggaatctaaacgccaaatgagttactttttagatgttttcctatttcctcaagaagacttagctttaaatgcaactgtcctcatgtggcctaggaaaattaatcccatctttgatgaaaatgatgagctaattgagaatgctaaacataaaaaagaaaatgaactaatggccaagagagagaaacttattttggaaatagaaaaagaatcacgccgcatggaggagtttacagaatttgcagagctggagcgcatgcaacagtatgtgacagatgtaagacaactacaaaaacgtattcaggaatctgaagaagcagtgcagtttattaataaagaagaggaacttttcaagtgggaattgacaaaatatcctgaactggataaattaaaagttaacattgagccctatcagaagttttttaattttgttttgaagtggcagcgatcagaaaaacggtggatggatggagggtttttggacctcaatggggaaagcatggaggctgatgtggaagagttttcccgagaaatttttaagacactaaaatttttccaaacgaagctaaagaaagaattacaagaaaaaagaaaggcagcaagaaaacggtctttggaagaagagaaaattgaagaagaaccaaaagacaatgctactattactatgtgcagtacagtcatggaacagataaaagcttttaaggaatatattcctactgtctccattctgtgcaatccaggaatgagagctcgtcactggaaacagatatcagaaattgtaggctatgacttgactccagactctggaactacactgagaaaagttttaaaattaaaccttaccccatacttggaacaatttgaagtgataagtgcaggtgcaagcaaggaattttcattagagaaagccatgaatacaatgataggaacttgggaagatattgcttttcatataagtctgtatcgtgacactggagtctgtattctttcttcggtggatgagattcaggccatccttgatgatcaaattataaaaactcagacaatgagaggctcacctttcatcaaaccatttgaacatgagatcaaggcctgggaggaccgcttgattcgaatacaagaaacaattgatgaatggttaaaagtacaagctcaatggctgtacttagagcccatcttttgttctgaggatatcatgcaacagatgccagaagaagggcgtcaatttcagacagtagacagacactggagagatatcatgaagttttgtgctaaagatccaaaggttcttgctgccacttctttaacaggtttattggaaaaactacagaactgcaatgaacttttggagaaaattatgaaaggtcttaacgcatatcttgaaaagaaacgtcttttcttccctcgttttttcttcttatctaatgatgaaatgttagagattttatcagagaccaaagatccacttagagttcagccacatttaaaaaaatgctttgagggcattgctaaattagagttccttcccaatttggacattaaagccatgtatagctctgagggcgagcgagtggagctgattgcactcatttccacgtctgcagcgcggggtgctgtggaaaagtggctcattcaagtggaagacctaatgctccggagtgttcacgatgtgatcgctgcagccaggctggcttatccagaatctgcaagaagagactgggttcgagagtggcctggccaagttgtactttgtatttctcaaatgttctggacatctgagacacaggaagtgataagtggcgggacggagggattaaagaagtattataaggaacttcagaaccaactgaatgagattgtagagctggtaagaggaaagttgtctaagcagaccaggaccactctgggggctttggttactattgatgtccatgctagagatgtggtcatggacatgattaaaatgggtgtctcacatgatacagatttcctgtggcttgctcagctccgatattattgggaaaatgagaatgcccgagttcgtatcattaattgcaatgtaaaatatgcttatgaatatcttggtaactcacctcgacttgtcattacgcctctaactgacaggtgttacagaacattgataggtgctttctatttaaaccttggaggtgctccagaggggccagcaggcacaggaaaaaccgaaaccaccaaggacttggctaaagctcttgctgtacagtgtgtggtgttcaactgttctgatgggctagattatctagcaatgggaaagttttttaaaggactggcttcttctggtgcttgggcttgctttgatgaattcaatcgaattgagttggaagtgttgtcagtggtagctcaacagatcctttgcattcagagagctattcaacagaagttggttgtgtttgtttttgaagggacagaacttaagctcaatccgaattgttttgtagctattaccatgaatcctggctatgcaggacgctctgaattgccggacaatcttaaggttctttttagaacagtggctatgatggttccaaactatgcgcttatagcagaaatctccctctactcttacggatttttgaatgcaagacctctgtctgtgaaaatagtaatgacctataggctttgctcagagcagctctcatcgcaatttcattacgactatggaatgcgagcagtaaaagccgttttagtggctgctggcaatctaaaactaaaatacccaaatgaaaatgaagatatacttcttcttcgatcaattaaagatgtaaatgaaccaaagtttttatcacatgatatacctttatttaatggaataactagtgacttatttcctggtattaaacttcctgaagctgactatcacgaatttttggaatgtgctcatgaagcctgcaatgtacataatcttcagcctgttaaattttttcttgaaaaaataattcaaacatatgaaatgatgattgttagacatggttttatgttagtaggagagccttttgctgctaagacaaaagttctgcatgtgctggcggatacgctaactttaatgaatgaacatggctatggagaggaagaaaaggtcatttatagaactgtaaaccccaaatctattactatgggccaactttttggacagtttgacccagtgtctcatgagtggactgatggtattgtggctaacacttttagagaatttgccttatcagaaacacctgaccggaaatgggttgtatttgatggtcctattgacactttgtggatagagagcatgaacacagtattggatgataataaaaagctttgccttatgagtggagaaatcattcagatgtccccccaaatgagcctcatctttgaaacaatggacctttcccaggcatcccctgccactgtaagtcgttgtggtatgatttatttggagccttcacagttaggatgggaaccacttgtgtcttcttggttgaattcactgaaaggacctctgtgtgaaccagaatatcaagctcttctgagaggactttttgcctggttaataccaccctctttaaaccagcgtaagaaaaaatgcaaggaactgattcctacaagcaacagcaacgtggttgtatctctcacacgcctctttgaagtgctactttgcaatgtggtagaaaatgatcctactagcaagcacattcgtgtttggattatggcttgctttatattctctttgatttggtcgattggaggaagttgtgatacagatggccgtcgtgtttttgatactttcatacgattaatcatactgggaaaagatgatgaaaacccagtgccagattctgtgggtaaatgggaatgcccatttgatgaaaaaggcctggtctatgactacatgtatgagttgaaaaacaaaggtcgctgggtccattggaatgaattaattaaaaatactaatttaggagataaacaaatcaagattcaagatatcatagtccctacgatggacacaattagatatacgtttctaatggatttgagtattacctatgcaaagccactcctttttgtgggtccaacgggtacaggaaaatctgtgtatgtgaaggataagctaatgaatcacttggaaaaggaccagtactttcctttttatattaacttatctgcacggaccagcgccaatcaggttcagaacattatcatggctagattggataaaagacgcaaaggagtctttggaccacctatgggaaagaagtgtataatttttatagatgatatgaatatgcctgcattggagaagtatggagctcaaccacctattgaattattacgacagttttttgactgtggacattggtacgaccttaaggacacaagtaaaatcacgctggtggacatagagctgattgctgcaatgggccctccaggtggtggaagaaatccagttactccccgttgtattcgacatttcaacatctgcagtattaattcttttagtgatgaaactatggtccgaatcttctcatctattgtagcattctaccttagaactcatgaatttcctccagagtactttgtaattgggaaccagatagtcaatgggactatggagatatataaacaatctgtggaaaatcttttacccactcccacaaaatcccattatactttcaacttgcgtgatttttcacgcgtcatccggggctgtttactcattgaaagagacgccgtggcgaacaaacacactatgatccgtctgtttgtgcatgaggttctccgagtgttttatgatcgcctcattaatgatgatgatcgaagatggctgttccagttaactaaaactgttataaaggaccattttaaagaatcatttcacagtatcttttcacatttgaggaaacaaaatgcaccagtaactgaagaagacttaagaaatctcatgtttggtgattatatgaatcctgaccttgaaggagatgatagagtttatattgaaattccaaatattcatcattttagtgatgttgtggaccagtgcttagatgagtataatcaaacacacaaaacaagaatgaatcttgtcatttttaggtatgttttggaacatttatcaagaatatgtcgagttctaaagcaatctggtggaaatgctttgcttgttggtcttggaggaagtggtcgtcaatctttaactcgtctggctacatccatggcaaaaatgcatattttccaaccagaaatttctaagagctatggtatgaatgaatggagagaggatatgaagggtctgttaaggaatgtgggcatgaagggccagaagaccgtctttcttatcacggacactcagattaaagaggaagctttcctagaggatatcgacagtgtgctcaatacaggagaagtgcctaacatttttgcagcagatgagaagcaggaagtgatggagggtgttcgcccagtagctcaggctggcaataaacatgatgaactcagtcccttagctctgtttgctttctttgtgaatcgctgcaaagataatcttcatgtcgtggtggcctttagccccattggagatgcctttcgaaatcgcttgagacagttcccatccctcatcaattgctgtaccattgactggtttcagtcatggcctgaagatgctcttgaacgtgtagctgtgaaattcttagaaacactggagcttactgaggttgaacaacaagagatagttccaatctgtaaacactttcacacctccattatggatctttcagaaaggttcttgcatgagttaggacgacataactatgttactgctacttcttatcttgaactcattggctcatttcgacagcttttgacacagaagcgacaagctgtcatggaagcaaaacaacgatacatgaatgggcttgacaaattagcttttgctgagtctcaggttggtgaaatgcaaatggagcttgttgaattacagcccaaattggaggaagctaaaattgaaaatgcaaatatgatgcaggttattgagatagagtctgtacaagtggaagcgaaaagacaatttgtgaaattggatgaagagatagccagtgggaaagctgaagaagcccaagctctgaaaaatgagtgtgaaagtgacctagctgaggcgattccagccttggaagcagctctgtctgcactggatacacttaagccagccgacattacgattgtgaaatcaatgaagaatcctccatctggtgttaaactagttatggctgctgtttgtgtcatgaaagatataaaaccagaaaaaatttcagatccttcagggactggaggcaagatattagattactggggacctagcaaaaaacttctgggagatatgaatttcttaagagatttgaaagaatatgacaaggacaacattccagtgactgttatgcagaagattcgtagtgaatacttaatgaaccctgaatttgatccccctaaggttgctaaagcttcttctgcagctgagggtctgtgtaagtggatcatggccatggaagtgtacgacagagttgcaaaggtagtggctcctaagaaagctcgcttatcagaagctcagaagtctttagctgagacaatggagcttttgaatcagaagagagcagaactggcagaagtagaacatcatctggaaaatttacaaatgacatttcttgagaaaacagaggaaaaggctgctttagaagaccaggtggaactctgtgctaagaagcttgaaagagcctcacaattaattggaggactgggtggagaaaaatcaagatgggcccaagctgcagatgaccttcagataacatatgaaaatttaactggcgatgtcttagtatcagcaggagtaatagcttaccttggtgctttcacttctggctttcgacaaacatgtacaaaagattggagcatgttgtgcaagaagaaaaaaatcccgtgttcagaggagttcttgttgagtaaaaccctgggtgatccagtaaaaattagagcttggaatattgctggtttaccaacagatacattttccatagataacggagtgatcgttaacaactgtaggcgttggcctttaatgattgacccccagggtcaagccaataagtggatcaaaaactctgaaaaagaaaatcagcttagtgttattaagctatcagattcagactatatgagaacattggaaaactgtattcagtttggaactccacttctattagaaaatgttggtgaagaactggatccatctttggagcctttactactcagacaaacttttaaacaaggtggcattgattgcatcagacttggtgaggtcattattgagtattcctttgatttcaaattttatatcaccacaaaactgagaaacccgcactatatgccagaactggctacaaaagtgtctttgctcaatttcatgataactccagaaggacttgaagatcaattactaggtattgttgttgcaaaggagagaccagaattagaagaggaacgaaatgccctgattcttcagtctgcagctaacaagaaacagctgaaagacatagagaaaaaaattttagaaacattatcatcatcagaaggaaacattttagaagatgaaagtgcaattaaagtcttagactctgccaaaatgatgtccaatgaaataacaaagaaacagcagattgcagaaaaaacagaactcaaaatagcagagtctcgagaaggctatagacccatcgccaaacactcgtcagtgttattctttagcattgcagacctggctaatattgatcccatgtatcagtactctctcacgtggtttgtgaacctttatatcaactctattcatgacagtaacaaatccaagattttggaaaagcgcctacgatatttaaatgaccacttcacatacaacttatattgtaatatatgccgatcactatttgagaaggacaagctgttattttcctttttattatgtgccaatcttcttctggcaaggaaagagattgaataccaggaactgatgtttcttttaactggaggagtaagtcttaaaagtgctgagaaaaatcctgatccaacttggctacaggacaaaagctgggaggaaatctgtcgggcaagtgaatttcctgccttcagaggactcaggcaacatttttgtgaacatatatatgaatggcgagaaatctatgacagtaaagagccacataatgctaaatttccagcaccaatggataagaacctaaatgaactacagaaaataataattcttcggtgtttaagacctgataagataaccccagctataacaaactatgtaactgacaaactagggaaaaagtttgtagagcctccaccatttgatttgacaaagagttacttggattcaaattgcaccattcccttaatttttgttctatctccaggagcagatcctatggccagcctgctgaaatttgcaaatgataaatctatgtctggaaataagtttcaagctatttcactgggacagggacaaggaccgattgcagcaaaaatgattaaagcagcaattgaagaaggaacttgggtgtgcctacagaattgccatcttgcagtgtcctggatgcccatgttggaaaaaatatgtgaagattttacctctgaaacctgtaactcatcctttaggctttggctgacaagctatccatcttcaaaattcccagtaacaattctacagaatggagtaaaaatgactaatgaacctcccacgggtcttcggctgaatctccttcaatcatatctcactgatccagtttctgatcctgagtttttcaagggatgccgtggaaaggaactggcctgggagaagttactgtttggagtttgtttttttcatgcccttgtgcaagagagaaagaaatttggtcctcttggttggaatattccatatggatttaatgaatctgacttgcgcatcagtatccgacaactgcagttatttatcaatgaatatgatacaattccatttgaagctatatcttacctgactggggagtgtaattatggaggaagagtgacagacgattgggacagacgtcttctattaaccatgctggctgacttttataatctgtacatagttgaaaaccctcattataagttttctcccagtggaaactattttgcacctcctaaaggcacttatgaggactacattgaattcattaagaaacttccatttactcaacaccctgagatatttggattacatgaaaacgttgacatctccaaggatcttcaacaaacaaaaaccctctttgagtccttgctcctcacccagggaggctccaaacagacaggagcctcaggaagtactgatcagattctgttagaaattaccaaagatatcctcaacaagctccctagtgatttcgacattgaaatggcactacggaagtatcctgtgagatatgaagaaagcatgaatactgtgttagtacaagaaatggaaagatttaacaatttaattataactatacgtaacactctacgggaccttgaaaaagctattaagggtgtggttgtgatggattctgcattggaggcactctccggtagcttacttgttggaaaggttccagaaatatgggccaaacgttcatacccaagccttaagcccctgggaagttacatcacagatttcctagcccggttgaactttttacaggactggtataattcaggaaaaccttgtgtgttttggctgtcaggtttctttttcactcaggcctttttaactggagctatgcagaattatgccagaaaatataccacccctattgatttgctaggatatgaatttgaggttatcccatctgatacatctgacacatcaccagaagatggtgtttatatccacggactgtatctcgatggcgcacgctgggaccgagaaagtggattgcttgctgaacaatatcccaaacttctgtttgacctgatgcccatcatatggataaaaccaactcaaaaatctcggattataaagtcggatgcctatgtctgtcccctctacaagacaagtgaacgtaaaggaactctttccactacgggacattctactaactttgtcattgcaatgttgttaaaaacagaccaacctactcggcactggatcaagcgcggggttgctttgctttgtcagttggatgactaaattggacaaatttataaaacatccaaaagtttaaaaaaaaaaaaacctgtcctacttaaaatatatacattataaaaccaag

SEQ ID NO: 128509 - DNA, 2254 bp, Homo sapiens
  Payload ID: 5153
  Gene Symbol: DNAH12
  Gene Name: dynein, axonemal, heavy chain 12
  ENST ID: ENST00000466540
  CDS Start-End: 1-2222
ttcatgacagtaacaaatccaagattttggaaaagcgcctacgatatttaaatgaccacttcacatacaacttatattgtaatatatgccgatcactatttgagaaggacaagctgttattttcctttttattatgtgccaatcttcttctggcaaggaaagagattgaataccaggaactgatgtttcttttaactggaggagtaagtcttaaaagtgctgagaaaaatcctgatccaacttggctacaggacaaaagctgggaggaaatctgtcgggcaagtgaatttcctgccttcagaggactcaggcaacatttttgtgaacatatatatgaatggcgagaaatctatgacagtaaagagccacataatgctaaatttccagcaccaatggataagaacctaaatgaactacagaaaataataattcttcggtgtttaagacctgataagataaccccagctataacaaactatgtaactgacaaactagggaaaaagtttgtagagcctccaccatttgatttgacaaagagttacttggattcaaattgcaccattcccttaatttttgttctatctccaggagcagatcctatggccagcctgctgaaatttgcaaatgataaatctatgtctggaaataagtttcaagctatttcactgggacagggacaaggaccgattgcagcaaaaatgattaaagcagcaattgaagaaggaacttgggtgtgcctacagaattgccatcttgcagtgtcctggatgcccatgttggaaaaaatatgtgaagattttacctctgaaacctgtaactcatcctttaggctttggctgacaagctatccatcttcaaaattcccagtaacaattctacagaatggagtaaaaatgactaatgaacctcccacgggtcttcggctgaatctccttcaatcatatctcactgatccagtttctgatcctgagtttttcaagggatgccgtggaaaggaactgttatttatcaatgaatatgatacaattccatttgaagctatatcttacctgactggggagtgtaattatggaggaagagtgacagacgattgggacagacgtcttctattaaccatgctggctgacttttataatctgtacatagttgaaaaccctcattataagttttctcccagtggaaactattttgcacctcctaaaggcacttatgaggactacattgaattcattaagaaacttccatttactcaacaccctgagatatttggattacatgaaaacgttgacatctccaaggatcttcaacaaacaaaaaccctctttgagtccttgctcctcacccagggaggctccaaacagacaggagcctcaggaagtactgatcagattctgttagaaattaccaaagatatcctcaacaagctccctagtgatttcgacattgaaatggcactacggaagtatcctgtgagatatgaagaaagcatgaatactgtgttagtacaagaaatggaaagatttaacaatttaattataactatacgtaacactctacgggaccttgaaaaagctattaagggtgtggttgtgatggattctgcattggaggcactctccggtagcttacttgttggaaaggttccagaaatatgggccaaacgttcatacccaagccttaagcccctgggaagttacatcacagatttcctagcccggttgaactttttacaggactggtataattcaggaaaaccttgtgtgttttggctgtcaggtttctttttcactcaggcctttttaactggagctatgcagaattatgccagaaaatataccacccctattgatttgctaggatatgaatttgaggttatcccatctgatacatctgacacatcaccagaagatggtgtttatatccacggactgtatctcgatggcgcacgctgggaccgagaaagtggattgcttgctgaacaatatcccaaacttctgtttgacctgatgcccatcatatggataaaaccaactcaaaaatctcggattataaagtcggatgcctatgtctgtcccctctacaagacaagtgaacgtaaaggaactctttccactacgggacattctactaactttgtcattgcaatgttgttaaaaacagaccaacctactcggcactggatcaagcgcggggttgctttgctttgtcagttggatgactaaattggacaaatttataaaacatccaaaagttt

SEQ ID NO: 128510 - DNA, 665 bp, Homo sapiens
  Payload ID: 5153
  Gene Symbol: DNAH12
  Gene Name: dynein, axonemal, heavy chain 12
  ENST ID: ENST00000494758
  CDS Start-End: 1-165
gatttcgacattgaaatggcactacggaagtatcctgtgagatatgaagaaagcatgaatactgtgttagtacaagaaatggaaagatttaacaagactggtataattcaggaaaaccttgtgtgttttggctgtcaggtttctttttcactcaggcctttttaactggagctatgcagaattatgccagaaaatataccacccctattgatttgctaggatatgaatttgaggttatcccatctgatacatctgacacatcaccagaagatggtgtttatatccacggactgtatctcgatggcgcacgctgggaccgagaaagtggattgcttgctgaacaatatcccaaacttctgtttgacctgatgcccatcatatggataaaaccaactcaaaaatctcggattataaagtcggatgcctatgtctgtcccctctacaagacaagtgaacgtaaaggaactctttccactacgggacattctactaactttgtcattgcaatgttgttaaaaacagaccaacctactcggcactggatcaagcgcggggttgctttgctttgtcagttggatgactaaattggacaaatttataaaacatccaaaagtttaaaaaaaaaaaaacctgtcctacttaaaatatatacattataaaaccaa

SEQ ID NO: 128511 - DNA, 8488 bp, Homo sapiens
  Payload ID: 5154
  Gene Symbol: DNAH14
  Gene Name: dynein, axonemal, heavy chain 14
  ENST ID: ENST00000327794
  CDS Start-End: 1-4444
tgaattatttggaaacagttcacaagtaggcatcaacctaccaactggtgaatgttccatctttggatattttgtggatatagagcaatgtgaattcataccttggtcagatttagttcctaatgatcagacactaattcaaagaggaacttcattactaactaatcttcaaagatctggcggaaacttcttgaagataacagaatgtggagaatgcattaattataccgctaccagagacacaacatgcctttcttttctcatgagccttcttttaaagaattcctgccctgtacttctcacaggagaatctggtgttgggaaaactgctgccattaatcaaatgcttgaaaagctagagggtccaggagcatttgacataaaacatggttcaattttaggagacaccctattatatagtgaaataaaaaaatcaagtagcctaaaacagaatatcaccatcttgattcctgaaactcataagacagcaactggaagttcagataatcccactaaaaagccagaagttagaactaataaaaagttacttaaaaataatgatcataaaggagttgtagtctctacaataaattttagcaccaatgtaacagctgccaaaaccaaggagatgattcttaagaagttaataagaagaactaaagatactcttggagcaccaaaaaacaaccggattctaatatttattgatgatatgaatatgccagtatcagatatgtatggagcacagccacccctggaattgataagacaattgttagatttgggaggagtttatgatactgaaaaaaatacatggaagaatattcaagatctgtctatagttgcagcttgtgttccagttgtgaatgatatcagcccacgtcttctcaaacacttttccatgctggtattacctcatccttcacaagacatcttatgtactattttccagcttctcctaggattgctgcaagctgacaggactgttgttaactccaaagagatggctgctctgctctttgttcatgaagccacccgagtatttcacgatcgcttaattgatttcactgataaaagccttttctatcggttgctttcaagggaacttgagaactgttttcagattcagtggacccaagaaaacctgatgaatcactcaactgtatttttggacttcttggatataaacaagactcatagaaaaaagatttatcagaataccagtgactataataaacttgccagtgtacttgatgaattccaaatgaagttgggttcaatttctttggagctttctcattccatggtgttcttcaaggaagccatagaacacatcataagagcaacaagggttcttcgacaaccagggagtcacatgttactgattggaatagatggatgtgggaaaaaaacatgtgcaaccttggcctgttatttgacagataataaactataccgagtgcctatatctcacaaatgtgcctacatcgaattcaaagaagtctttaaaaaggtgtttattcacgcaggattaaaagggaaacccactgttctgatggttcccaatttaaacatagaacaagactcatttttagaagatttgaactacatcatcagttcaggaagaatacctgacctgtttgaaaatgttgagctggattctattgcaatgaaaatcagatatcttactgaacaatctggtcatatggataataggcaatctttactttcattctttcaaaagagaatatataaaaatcttcatatttttgtgatcatgagtcctgaaggacctagcttccgccaaaattgtagagtgtatccttctatgattagctcctgcacgatcgattggtatgagaggtggccagaagaagctctccttattgtagctaactcattcttaaaagaaaaggtcaattttgagaacagagagaacttgaaagaaaaacttgccccaacatgtgtccaaatccacaaaagcatgaaagacttgaacagaaaatactttgaagaaactggaagattttattataccactcccaatagctacttgcaatttatggaaacatttgcacacattttgagggcacgagaggaagagatgcaaacaaagagggatcgcttccatatgggtctatccacaatcctggaagcaaccactctagttacagaaatgcaagaagagctcttgattcttggccctcaagtagaacaaaaaacaaaggaaacagaaactctaatggaaaaactacggaaagattcacaagtagttgagaaagttcagatgcttgttaaacaggatgaagaaattgtggcagaagaagtaagaattgtggaagattatgctcagaaaactgccaatgaactaaaaagtgtgctgccagcctttgacaaggcaattgtggctctgaatgccctggataaagctgatgtcgctgaattaagagtatacacacggcctcccttccttgtactgactgtcatgaatgcagtgtgtattcttctgcaaaagaaacctaactgggcaacggcaaagttacttctttcagaaactggtttcctgaaaaaattgattaaccttgacaaggacagcatacctgataaggttttcgtgaagctaaaaaaaattgtaaccttacctgatttcaacccacacaagatttcgctggtttctgttgcttgttgctccctgtgccagtgggttatagctttgaataactaccatgaagtacagaaggttgtgggccctaaacaaatccaagtagctgaagctcaaaacgtccttaaaattgcgcgacaaagacttgctgagaaacaaagaggtttacagctggttgaagaacatttgctgtttttacaggcagcttacaaagataccgttgctgaaaaacaactattagcaaatcggaaaacaatggccagcaggcgctttcagtgtgcgtcagtcttactaactgtcctggaagatgagaagatcagccgatggcataatcagggactgcctcatggtcagtattcagtagagaatgccatcttgatcaagaatggccagcagtggccactgctgattgacccacataggcaagctcacaaatggatccgtcagatggaaggatccaggctgcagaagctctccattgaagacagcaattataccaaaaaaattgaaaatgctatgaagacaggagggagtgtcctcctgcagaatctccttgagacattagctccaggcttaaaggcaattctgaaaaaggatatctatcagaaaaaaggacactatttcataagggttggtgatgctgagttcgaatacaattcaaattttaggttatacttatctacagaaatagacaacccccattttcttccatcagtttataactttgttactatgatcaacttcactgtaacattccaaggtttgcaagatcaactcttgtctactgtggtaactcatgaagttcctcatttagaagatcaacgttccaagttactggagagtatttcccttgatgccataactcttgaagaactagaggaaaaaacattaaatttactgcagaaagcactaggatccatattagatgatgacaaaattgtagataccttaagaaaatccaaaatgacatcaaacgaaatttcaaagcgcatcgaagcaacaaaaaaagctgaaagtgaaatccaagcaatacgtaaaaactatctccccattgcgacccgaggcgccctgctctacttcctagtagctgatctcacacaaatcaactacatgtaccagttctccctagactggtttcatcaggtttttgtttcatcagtagtttccaaaagcaaagaacaagaacatagttttaaaagggagaaagtgtctccaaaagaagttcatgagtttataagtatttcaaaagaacccaacctggaaaatgagaaaaatctcttagataagcatattaaaagtgcaatagacatgttgacaaaaagtatttttaaggtggtttcttcagctctatttaatgaagataaactttgcttctcttttcggctttgcactgtaatcatgcaaaacaatgctaatggaaatctaatacaggatgacattggattcctaccagaagaagaatggaacatctttttatattctggcatattgataaatattaaaagtgcattatcccagtctagacttactagcacatttgaaataggtgaaagtcaacatcttcagtggctgtcagattccaggtggaggcagtgccaatatgtcagcactcacctggaaccattttcacttctgtgcaaatcccttttatcaaacgtatcacaatgggatacttttaagaacagtaaagcagtttattctctgatcagcacacctttctcttcagaaaatgcttcattggaggaaaatacaaaaccaccagaggaaagtaaaagttcttagaccagaaagtttaaacaattcagtgagaaagtttataactgaaaaaatgggaaataagtatcttcaaagaactggagttaatttgaaagatgcatataaaggatccaatgccagaactccgctgatacttattcaaactcatgggatcgaccttaccaatatcctcctgagatttgcacaagagttaaaaggaacaacacatcatgtgaccataatttctctgggccgtgaccaagcagctaaagctgaagacctcattttaaaggcactaacaaaaacacaacaatgggtcttcctccagaactgccatcttgcaacatcatttatgccaaggctttgcacaattgtagaatcttttaatagtccaaacgtgacaatagaccctgagtttcggctatggttaagctcaaaatcatacagttcttttccaattcctgttcttaaaaagggtttaaagattgccgtggaatctccccagggattgaaaagtaacttacttcagacatttggatgtactgggagtggagaggttgccattaaggtgttggaaaattccctgagaggacagcccagcatttcgtggcaagcactgcgctacctgattggagaagtgatttacggtggccgggtgattgataattgggacaagcgatgcttgaagaccctactctacaaattttgtaatcctgaagtgctgaaagatgacttcagtttctccagtgatgggatatgtctgccagttccaggatctgcaagcataaaggactacatacacattatccagtccttacctgatgatgaccttcccgaggtcttaggaatacacccagaggccatcaggagctgctgggagacccagggcgaaaagtttattgaaaatctgattgccatgcaaccaaaaactaccactgccaacctcatgatcagacctgagcagagtaaggatgaactggtgatggaaattctatccgacttgctaaagcggctgccactgacagtggagaaagaagaaattgctgttggaactccaagcacattgaagagcatgatgtcaagctccatttgggagtctctttctaaaaatctcaaagatcacgacccccttatccattgtgtcttgctaacctttttgaagcaagaaattaaacgatttgataagttattatttgtcatacataaatccttaaaagatcttcagcttgctataaaaggagagatcatcctcacccaagaattggaggaaatatttaactcttttcttaatatgagagtgcctacattgtggcagaaacacgcctacagatcttgtaagccactgagttcctggattgatgatctcatccagcgactgaatttcttcaatacttgggccaaagtggcttatactgcaatacagcgtcggtatatgagatttgtcacagtttggaagcagtctattccatcaactagccaaaaatgcaaacaccctgaggattcagagaacaatttctttgaagggtttccttcaagatactggctcccagctttcttctttccacaagcctttcttgctgctgtgcttcaagactatgggaggtcccgaggaatcgctgtggatgccctcaccttcacccaccatgtgatttccaacaccactgacaaggatgagaagttctccgtatttatgccaaagaaactcaacatagtcaggagagcgtttaagggttctcacagtttctggtccactggggatacttcttgttttccggtgctttcatagttgcattctgggatttggagtgggaggaggtggtggacactcatgctgtttggcctctgggtcctggtcttcctctcctcagcactcatcagactgcactaagatgattccgagactacccagaattagtgaacgttaggaacatgtcagaagaaggatggaactgggagagtttgtcctacaaggcaaaagactctgaggagaaaaagaaatattgaaaagggtgatacatgaagaactagactctaattctgctagaactccaaccagggggacctccaaggggaagacacatgcagttgatctaaattgatgatgatggtggcgtgtccttttatagacagggagttccctgtcactggagctttaggagaaatcaggtgactgcttggcaagagtattgacgtggaagaaagctcaggttcagatgtgttttcgactggaggtttatccaactgtttatttaaaatatgggtccaaaactgctctggctgttggaaatatcgagatgaacaacgtaaggcctctgccctctagaagatcccaatctacctgataatgatggcactgatgcttgctagccaacactgactaagtactatgtgctaagctctttacctgcattatttaatcctcacaaattagcctcattctgtaggtcaggaaactaaggttcaaagaggcagatcataagctttgaacccaccaagtctagctgactctacacccatagcctaacctcttcctacataacccattagacatgaaaaggctaccgagaggcagatgtgcaccagggccttttcttatgactcacagagggagcacaggggtatggactgcccgcctaagtttgctttttgcctctattcatctaatcagatgttctcacttatttctgctttatacaaacaaccagcttccactgagttgaagtaagattacttccatttattctgagtggctctttgaagagttaaatcactccaaaaggggctgtttacaaattacctacagtttagatttttcagaggaaaaacccatgtaagctatgaccaagttacacaagtataaatggaagtgacattgtcaaatgcgttagattaacttcttccaagattgttaggaaaggacaacactagaacaaatgcagtataggaaaatttgcatttatataagttaaggggaagagaagtaaaaagcattatacaaagcaattcccagtaaaattcttttttttttttttgagatggagtcttgctctgttgcccaggctggagtgcagtggcgtgatctcagctcactgcaacctccgcctcctgggttcacgccattcccctgcctcagcctcccgagcccggctaattttttgtatttttagtagagacggggtttcaccgtgttagccaggatggtctcgatctcctgacctcgtgatccgcccgcctcagcctcccaaagtgctgggattacaggcgtgagccactgcgcccggccaaaattcttttatagaataagccaaaataggaagtgcttaatatgagttcagcttgcacctccaggtagtcacattccagagtggacaacacagaaggcatcaccaggcacagcacaggctgttccacactgcctcccctgtgtcaacaagctggcccaggctgcatcaagggagagctcaggacagcggtgcccaccccttctcttcagagacctgccccatcagaggagatggcagagccctccagggtggcctggtacttggccaccagctcctccaggctgggcatccctccagcacacctgcaggagagcatgtggcttcacaggcctacctcaggcacacctggagtcacctggaattggagctgcaggcaactaaattttctacttcacagacctcatcagaaactcattttacttaaccctttatcattaaaatgtaatcctctatttaacctatatcattcaaaaatatatggaacccggccgggcatggtggctcacacctgtagtcccagcactttgggaggcgaagagagacggatcacttgaggtcaggagttcgagaccagcctggccaacgtgatgaaacccgatctctactaaaaatacaaaaaattaggcgggcgtggtggtgtgctcctgtaatcccagctactcaggaggctgaagtgggagaaccgatggaacccaggcggtggaggttgcagtgagccaagatcatgccactgcactccagcctaggcaacagagcgagaccccatgtcaaaaaaaaaaaaaaaaaa

SEQ ID NO: 128512 - DNA, 612 bp, Homo sapiens
  Payload ID: 5154
  Gene Symbol: DNAH14
  Gene Name: dynein, axonemal, heavy chain 14
  ENST ID: ENST00000328556
  CDS Start-End: 1-612
aaatgctaatatctgctgaaggggaaggtctcgtgctgccaaagaaaattcgtgtaagaagtgctgtagaacagtggctggtaaatgtagaaaaaagcatgttcgatgtgctaaaaaaatttttaagtcaagggattgaagactggaactgccagatgttttcccaatgggtgttatctcatccaggacaagtggtacttactgtgagccagatcatgttttataatgattgtgttaaaagttttgtgagttcttattcaagagaaaaattggaaaaagtccacgctggtctgatgtgtcatctagaagaggttgcagacctggtagtgctggatactagtaactctcgaacaaaagctatactaggggcattgcttatcctttatgttcactgcagagatatagtgataaatttactacttaaaaatatcttcaatgcagaggattttgagtggacaagacatttgcaatataaatggaatgaaaaacaaaagttgtgctatgtgtctcaaggaaatgccagctttacttatggctatgagtacttgggctgtacctcaagattggttattacgcctctcacagaccgatgctggctgactctcatggaag

SEQ ID NO: 128513 - DNA, 929 bp, Homo sapiens
  Payload ID: 5154
  Gene Symbol: DNAH14
  Gene Name: dynein, axonemal, heavy chain 14
  Uniprot ID: Q0VDD8
  ENST ID: ENST00000366848
  CDS Start-End: 34-720
ccagttcctttatagttttgttcagaaaaacatatggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaagagatacttggtcatttgtggagcagtttatatataagaatctccttgggagcatgttatttaatagtgaagtttttccttttgtgtagagatttaggtttgaagattcaactttaataaattttttcatctatcaaatactttgttaatacttggggtaaatttttacaggaagaactacaaaacaagcatttgctagcttaatgggaactataataataaagaaaagaatattctttattggca

SEQ ID NO: 128514 - DNA, 2215 bp, Homo sapiens
  Payload ID: 5154
  Gene Symbol: DNAH14
  Gene Name: dynein, axonemal, heavy chain 14
  ENST ID: ENST00000366849
  CDS Start-End: 188-1480
ggttacggccaggaggcgtcggagcctggcgtggtagggctgtgctgcgcggtccttcccattcaccctagtctggcgctcgccggcgtgggcgggccggaccttcgccgcttccaggaagggccacaacggccgtcggaccacggcgcggcggccagttcctttatagttttgttcagaaaaacatatggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggttattaatatagttggtagtgtaaaggaagtagaactcatacctactttggaatggctatcagaaagaagacattactatttattacggcaattcaagatattttctgatttccgaatgaataaagcatttgttacctggaaattgaatgttaaaagaattaagacagagaagagcaggtcatttttgtaccaccatctttttttggctgatgacttgtttcaaacctgtttggtttatataagaggactttgtgaagatgcaattaatctcaaaaattataatgaccatgaaaataatctatctgccatatgccttgtaaagctggatagttctcgaacatattctctagatgaattttgtgaagagcagttacagcaagctacccaggcattgaaacaacttgaggacatcaggaataaagcaatttcagagatgaaaagtacttttctaaaggttgcagaaaagaatgaaatcaaagagtattttgagtcaaaactctctgaagatgacacaacacatttcaagctgcctaaatatagacgtttattagaaacatttttcaagtttgtaatgctggttgactacatatttcaggaactcattcgtcaacttatgaacactgcagtcacactacttttggaattatttaatggttctgctggaatgccattttcagtggaaaaaaagaatgaaaatcttatcaggtaaattacttttttgaagtcaaaaagtaacttacaattataatattttaacattgccacatatggaggaaatattcaataatttaagctagagtttgaaaattctccttgtggcagagtacatgtactcatttttgctattaacagaacttattatttggtaataccttacttaatatcggtgctataggatgcgcagtaaaatttgaatttcacataaatggtaaataattttagtatacttcaagtattacctatgttaaaattattgtttatctgaaattcagatttctctgataatttagcaaatatattttttatttgttatatctggcaattctgtgcctaagtatactctgtcttccaggttcagagttagtttttaaagatatgtgagaattctggaaggagctacaaagtccaattggaatttgagtcaattccaagaaatatctgttgaatattttcccaatgaaaaaactatctgaaaaacatttttaccttctaaacactactgttaaaaacaaagcatttttcttattttccacaactggatatatctactgtaactggtgaaacaggaatattaattgaaatgatggcatactttgtagctggtaaacaggactatgaattgaaatgttggcatactttaatttctatttatcaaaatttaataatattttaggctaattaaagttttataactaggtagctgaaaatatatcaattcaaaaaa

SEQ ID NO: 128515 - DNA, 1103 bp, Homo sapiens
  Payload ID: 5154
  Gene Symbol: DNAH14
  Gene Name: dynein, axonemal, heavy chain 14
  Uniprot ID: Q0VDD8
  ENST ID: ENST00000366850
  CDS Start-End: 209-895
aggcgtggctcttggtcaggcggttacggccaggaggcgtcggagcctggcgtggtagggctgtgctgcgcggtccttcccattcaccctagtctggcgctcgccggcgtgggcgggccggaccttcgccgcttccaggaagggccacaacggccgtcggaccacggcgcggcggccagttcctttatagttttgttcagaaaaacatatggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaagagatacttggtcatttgtggagcagtttatatataagaatctccttgggagcatgttatttaatagtgaagtttttccttttgtgtagagatttaggtttgaagattcaactttaataaattttttcatctatcaaatactttgttaatacttggggtaaatttttacaggaagaactacaaaacaagcatttgctagcttaatgggaactataataataaagaaaagaatattctttattggc

SEQ ID NO: 128516 - DNA, 1984 bp, Homo sapiens
  Payload ID: 5154
  Gene Symbol: DNAH14
  Gene Name: dynein, axonemal, heavy chain 14
  Uniprot ID: Q0VDD8
  ENST ID: ENST00000400952
  CDS Start-End: 203-1564
ggctcttggtcaggcggttacggccaggaggcgtcggagcctggcgtggtagggctgtgctgcgcggtccttcccattcaccctagtctggcgctcgccggcgtgggcgggccggaccttcgccgcttccaggaagggccacaacggccgtcggaccacggcgcggcggccagttcctttatagttttgttcagaaaaacatatggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaaggttattaatatagttggtagtgtaaaggaagtagaactcatacctactttggaatggctatcagaaagaagacattactatttattacggcaattcaagatattttctgatttccgaatgaataaagcatttgttacctggaaattgaatgttaaaagaattaagacagagaagagcaggtcatttttgtaccaccatctttttttggctgatgacttgtttcaaacctgtttggtttatataagaggactttgtgaagatgcaattaatctcaaaaattataatgaccatgaaaataatctatctgccatatgccttgtaaagctggatagttctcgaacatattctctagatgaattttgtgaagagcagttacagcaagctacccaggcattgaaacaacttgaggacatcaggaataaagcaatttcagagatgaaaagtacttttctaaaggttgcagaaaagaatgaaatcaaagagtattttgagtcaaaactctctgaagatgacacaacacatttcaagctgcctaaatatagacgtttattagaaacatttttcaagtttgtaatgctggttgactacatatttcaggaactcattcgtcaacttatgaacactgcagtcacactacttttggaattatttaatggttctgctggaatgccattttcagtggaaaaaaagaatgaaaatcttatcaggtaaattacttttttgaagtcaaaaagtaacttacaattataatattttaacattgccacatatggaggaaatattcaataatttaagctagagtttgaaaattctccttgtggcagagtacatgtactcatttttgctattaacagaacttattatttggtaataccttacttaatatcggtgctataggatgcgcagtaaaatttgaatttcacataaatggtaaataattttagtatacttcaagtattacctatgttaaaattattgtttatctgaaattcagatttctctgataatttagcaaatatattttttatttgttatatctggcaattctgtgcctaagtatactctgtcttccaggttcagagttagtttttaaagatatgtgagaattctggaaggagctacaaagtccaa

SEQ ID NO: 128517 - DNA, 13548 bp, Homo sapiens
  Payload ID: 5154
  Gene Symbol: DNAH14
  Gene Name: dynein, axonemal, heavy chain 14
  Uniprot ID: Q0VDD8
  ENST ID: ENST00000439375
  CDS Start-End: 1-13548
atggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaaggttattaatatagttggtagtgtaaaggaagtagaactcatacctactttggaatggctatcagaaagaagacattactatttattacggcaattcaagatattttctgatttccgaatgaataaagcatttgttacctggaaattgaatgttaaaagaattaagacagagaagagcaggtcatttttgtaccaccatctttttttggctgatgacttgtttcaaacctgtttggtttatataagaggactttgtgaagatgcaattaatctcaaaaattataatgaccatgaaaataatctatctgccatatgccttgtaaagctggatagttctcgaacatattctctagatgaattttgtgaagagcagttacagcaagctacccaggcattgaaacaacttgaggacatcaggaataaagcaatttcagagatgaaaagtacttttctaaaggttgcagaaaagaatgaaatcaaagagtattttgagtcaaaactctctgaagatgacacaacacatttcaagctgcctaaatatagacgtttattagaaacatttttcaagtttgtaatgctggttgactacatatttcaggaactcattcgtcaacttatgaacactgcagtcacactacttttggaattatttaatggttctgctggaatgccattttcagtggaaaaaaagaatgaaaatcttatcagaacattcaaggacaactcttttcctactggaaagacaacaaatgattgtgaagaacttgttgataattcaaagttacatgctatttctgttcaaaagtcagaagtaaaaacagacactgatattaatgagattttgaatagtgttgaagtggggaaggatttgagaaaaacatatgcaccaatatttgaagtaaatctatgcttgagaattcctgctgagagtgattcttcagaaaattctaaagagaactttcatgagtctgaccagtgccctgaagagtgtgtgatgtttgaagatgaaatgtcagaaaataaagacaattgtgtcaaaaaacactcaagtgaagaattgctcccaaaagccaagaaatcaaaagaaattagttacaatcttgaagatattatttcagacacagaaattgagactgagtttgagaataaatacatgtattatgaatttccagaatttcctacaaatctctttatagatcccaacagattggagttttcagtaaaaattcaaaatatgttgactaatatggaaaaatgtataaccacaattactcctctttgccaagatccccagctgtctatcttcattgatttggtttcaataatggatttacctaataagacaggaagcataatacattataaagagcagaccagatggccagattgtcacatcctttttgaaacagatcctgcctaccaaaatataattgtgaatctcctgactattattggtaattcaatgggcctagttaatgcttacagccacaagtttataaagtattgtaccatgacagaaaaggccaaaatcatgagtatgaaaatatcatctatgggagaattaacttcaaaagaatttgaagctattctaaatagattcagaaactattttagacatattgtgaatatggccattgagaagcgtattggtattttcaacgttgtaagtcttgattatcaatcagaatgcttactgtatattgacaacgtcatacatatgagccacaccctcatacaatctgtaattgaaaaaaagaacaaaaatttattggaagttgtggaatcatcattgcagcagctggaatgtgatcccactgaaatagaagaatttctggagcattttatttttttgaatgcaatttcctcaaaaatatctaaattagaaaaagagttcttaacaatgtctcagctatattctgttgcaaagcatcaccagatccatatttcagaagagcaaattgccatattccaagttcttcttcttaagtttagtcaactaaaatcatctatgaagttaagtaaaataaataaagacactgctataactaaattcagagataacttggaagcatgtatcagtggtctacatgttgatgttggcaatttaaaagccaagataagaactcctcttctgttatgtgctggtactcaagtgtcaacagcaatggaaatgatccagactctctcaggggaagctgcaagtttaactaacaaagctaaagcatattcacattatcaggattgtttcagtgattctcaatctcatatgcattctgttaatgtggaagaaattacacagattgtgctttcagagatctctgacattgaaggtgacttgactttgaggaaaaaactatgggaagcacaagaggagtggaagcgagcctcttgggaatggaggaatagttctcttcaaagtattgatgtagaatcagtacagagaaatgtttcaaaactgatgcacataatctcggtactagaaaaaggtttacctaaaagcgatatggtaacacatcttaagcaagtggtaacagagtttaaacaagagctgcctatcattatagctctgggaaatccctgtctcaagccaaggcattgggaggctctccaggagattattgggaagtcagttccgcttgataaaaactgtaaagtagagaatcttctagctctcaagatgtttcagtatgaaaatgaaataaatgatatgtcaacctcagcaactaatgaagctgctcttgaaaaaatgctatttaagattattgatttttggaacactactcctttgcctttaattcttcaccacacagagatttactctatcttcataattccatctatagatgacatatcagctcagttagaagagtctcaagtcatacttgcaacaattaaaggatctccccacattgggcccattaaggatcttgtgaatgaatgggatcaaaacttgactctcttctcttacacccttgaggaatggatgaattgtcaaagaaattggctttatcttgaaccagtctttcattcttcagaaatacgaaggcaactcccagcagaaacagaacttttctctcaagtgatttccatgtggaaaaaaataatgtcaaaaatacaaaacaaacagaatgctttgcagataaccacttctgcaggagtccttgaaattctgcaaaattgtaatatacatcttgaacatataaagaaaagccttgaggattaccttgaagttaaaagattaattttcccaagattttactttcttagcaatgccgagcttcttgatattctagctgatagcagaaatcctgagtctgtacagcctcatcttgtgaaatgctttgaaaatataaaacaattattgatatggaaacaagacattggccctcctgctgtaaaaatgctaatatctgctgaaggggaaggtctcgtgctgccaaagaaaattcgtgtaagaagtgctgtagaacagtggctggtaaatgtagaaaaaagcatgttcgatgtgctaaaaaaagagagatatatatataacattatcttactttttcagagccagatcatgttttataatgattgtgttaaaagttttgtgagttcttattcaagagaaaaattggaaaaagtccacgctggtctgatgtgtcatctagaagaggttgcagacctggtagtgctggatactagtaactctcgaacaaaagctatactaggggcattgcttatcctttatgttcactgcagagatatagtgataaatttactacttaaaaatatcttcaatgcagaggattttgagtggacaagacatttgcaatataaatggaatgaaaaacaaaagttgtgctatgtgtctcaaggaaatgccagctttacttatggctatgagtacttgggctgtacctcaagattggttattacgcctctcacagaccgatgctggctgactctcatggaagcactacacttgaatctaggaggctgtcctgccggtccagctggtacaggaaaaactgagactgtcaaagatctagcaaaatccttaggcaaacattgtgtggtcttcaactgttttgaggatttggattataagatagtgagaaaatttttctttggactagttcagtcaggagcatggagttgttttgatgaattcaatctaattgatttggaagttctctctgtcattgcctcacagatcctaacaattaaggctgcaaaagacaactattctgccaggtttgtactggaaggaaaagaaattcgtatcaatatgtcttgtgcggtatttatcaccatgaatcccagatacggaggtggagtagagctcccagataacttaaaatctctgtttcgcccagtggcaatgatggtgccccattatcaaatgattgctgaaataatattgttttcatttggtttcaaatctgcaaattcactctctggaaagctaactaacctttatgaattagcgcgcaaacagctctcacaacaggatcattataattttggcttgagatctctgaagatagttttaataatggctggaacgaagaaacgggagtttaaatgtctttctgaagcagatgaaaccttgattgttatcgaggctataagagaagctagtttgccaaaatgtcctcctgaagatgtcccactttttgaaaatattataggagatatttttccagaagtgacagttttgaaagtaaatcaacttgccttggagaaagtaatatatactgcaactcagcaattgggtttacaaaactggtcatctcagaaagagaagattatacagttttataatcaacttcaggtttgtgttggtgtgatgttagtgggcccaacaggtggaggaaagacaacagtcagaagaattttggaaaaagcattaacgctattaccaattgcagacttcttatcagttgcagaaagaaaatctgcttcaaagatttcagaaagaaaaggaaaagtagatatttgtgttttaaatccaaagtgtgtcactctcagtgaactatatggacaactggatcctaatactatggaatggactgatggattattatcagcaacaattcgaagttatgtatattttaacacaccaaagaacacaaagaaagacattgatctcagactaaagtcaagaatctcagatttatccaatgttttcaaacttgattcctctgatacaacagagactgatgataatatttttgaggagatagagaaagttgttaaaattccagaaaatcacaattttgattggcagtggattatcctagatggcccagtggacaccttttgggtagaaaatctgaactctgtgctagatgatactagaacattgtgcctagcaaacagtgagagaatagctttaactaataaaataagagtgatttttgaagtggacaatctctctcaggccagtcctgctactgtcagccgatgtgccatggtctatatggatcctgttgatctgggatgggaaccttatgttaagtcatggcttctgaaaacttctaaaattataagtcaatcaggagtggattgtcttgaattcatgattaaaaatagtgtcacagacggactacaatttataaggaatcgtcagaaatttcagccatatcctatggaggacataacagtcgtcataaccctctgcagaattcttgatgctttctttgacttcatgggtaaaaatggaggatttgaacaaagtgatgatttgaatgacacgtcatctaaggaggcaaattcccaaagagagtctgtcacattcaaggatatagaaaagagggatgaaaatacatggtatccagagaaaaatcctgataaattaacaaaaattattcaaaagctttttgtgtttgcctttacttgggcatttggaggagctttaaaccgtgaagatgaacacagagaaaatataccattttgtcccagtcttgaacctgattctcttgcaaaagtaacatacgattttgacaaacttgttcatgaattatttggaaacagttcacaagtaggatggaagcactggggtcagtcacagggcagacggagaaaggggaactgcatcaacctaccaactggtgaatgttccatctttggatattttgtggatatagagcaatgtgaattcataccttggtcagatttagttcctaatgatcagacactaattcaaagaggaacttcattactaactaatcttcaaagatctggcggaaacttcttgaagataacagaatgtggagaatgcattaattataccgctaccagagacacaacatgcctttcttttctcatgagccttcttttaaagaattcctgccctgtacttctcacaggagaatctggtgttgggaaaactgctgccattaatcaaatgcttgaaaagctagagggtccaggagcatttgacataaaacatggttcaattttaggagacaccctattatatagtgaaataaaaaaatcaagtagcctaaaacagaatatcaccatcttgattcctgaaactcataagacagcaactggaagttcagataatcccactaaaaagccagaagttagaactaataaaaagttacttaaaaataatgatcataaaggagttgtagtctctacaataaattttagcaccaatgtaacagctgccaaaaccaaggagatgattcttaagaagttaataagaagaactaaagatactcttggagcaccaaaaaacaaccggattctaatatttattgatgatatgaatatgccagtatcagatatgtatggagcacagccacccctggaattgataagacaattgttagatttgggaggagtttatgatactgaaaaaaatacatggaagaatattcaagatctgtctatagttgcagcttgtgttccagttgtgaatgatatcagcccacgtcttctcaaacacttttccatgctggtattacctcatccttcacaagacatcttatgtactattttccaggctcatttgggaatttatttctccatcaataacttcacacctgaagttcagaaaagtaaggatcagataatatcttgttccctagctatataccatcaagtacgtcagaatatgttaccaactccaacaaaatgtcactacatgtttaatcttcgagatatgtttaagcttctcctaggattgctgcaagctgacaggactgttgttaactccaaagagatggctgctctgctctttgttcatgaagccacccgagtatttcacgatcgcttaattgatttcactgataaaagccttttctatcggttgctttcaagggaacttgagaactgttttcagattggaatagatggatgtgggaaaaaaacatgtgcaaccttggcctgttatttgacagataataaactataccgagtgcctatatctcacaaatgtgcctacatcgaattcaaagaagtctttaaaaaggtgtttattcacgcaggattaaaagggaaacccactgttctgatggttcccaatttaaacatagaacaagactcatttttagaagatttgaactacatcatcagttcaggaagaatacctgacctgtttgaaaatgttgagctggattctattgcaatgaaaatcagatatcttactgaacaatctggtcatatggataataggcaatctttactttcattctttcaaaagagaatatataaaaatcttcatatttttgtgatcatgagtcctgaaggacctagcttccgccaaaattgtagagtgtatccttctatgattagctcctgcacgatcgattggtatgagaggtggccagaagaagctctccttattgtagctaactcattcttaaaagaaaaggtcaattttgagaacagagagaacttgaaagaaaaacttgccccaacatgtgtccaaatccacaaaagcatgaaagacttgaacagaaaatactttgaagaaactggaagattttattataccactcccaatagctacttgcaatttatggaaacatttgcacacattttgagggcacgagaggaagagatgcaaacaaagagggatcgcttccatatgggtctatccacaatcctggaagcaaccactctagttacagaaatgcaagaagagctcttgattcttggccctcaagtagaacaaaaaacaaaggaaacagaaactctaatggaaaaactacggaaagattcacaagtagttgagaaagttcagatgcttgttaaacaggatgaagaaattgtggcagaagaagtaagaattgtggaagattatgctcagaaaactgccaatgaactaaaaagtgtgctgccagcctttgacaaggcaattgtggctctgaatgccctggataaagctgatgtcgctgaattaagagtatacacacggcctcccttccttgtactgactgtcatgaatgcagtgtgtattcttctgcaaaagaaacctaactgggcaacggcaaagttacttctttcagaaactggtttcctgaaaaaattgattaaccttgacaaggacagcatacctgataaggttttcgtgaagctaaaaaaaattgtaaccttacctgatttcaacccacacaagatttcgctggtttctgttgcttgttgctccctgtgccagtgggttatagctttgaataactaccatgaagtacagaaggttgtgggccctaaacaaatccaagtagctgaagctcaaaacgtccttaaaattgcgcgacaaagacttgctgagaaacaaagaggtttacagctggttgaagaacatttgctgtttttacaggcagcttacaaagataccgttgctgaaaaacaactattagcaaatcggaaaacaatggccagcaggcgctttcagtgtgcgtcagtcttactaactgtcctggaagatgagaagactcgatggcaagaaacaatcaatcaaatagataacaaattagaaggaattttgggtgacatacttctttcagcagcgtgcattgtctacagtggaattttaacaccagaatttcgccagttgattgtgaataaatgggagacattctgcattgaaaatggcatttctttgtcttccaaattctctttaattaaagttatggcacaaaaatatgagatcagccgatggcataatcagggactgcctcatggtcagtattcagtagagaatgccatcttgatcaagaatggccagcagtggccactgctgattgacccacataggcaagctcacaaatggatccgtcagatggaaggatccaggctgcagaagctctccattgaagacagcaattataccaaaaaaattgaaaatgctatgaagacaggagggagtgtcctcctgcagaatctccttgagacattagctccaggcttaaaggcaattctgaaaaaggatatctatcagaaaaaaggacactatttcataagggttggtgatgctgagttcgaatacaattcaaattttaggttatacttatctacagaaatagacaacccccattttcttccatcagtttataactttgttactatgatcaacttcactgtaacattccaaggtttgcaagatcaactcttgtctactgtggtaactcatgaagttcctcatttagaagatcaacgttccaagttactggagagtatttcccttgatgccataactcttgaagaactagaggaaaaaacattaaatttactgcagaaagcactaggatccatattagatgatgacaaaattgtagataccttaagaaaatccaaaatgacatcaaacgaaatttcaaagcgcatcgaagcaacaaaaaaagctgaaagtgaaatccaagcaatacgtaaaaactatctccccattgcgacccgaggcgccctgctctacttcctagtagctgatctcacacaaatcaactacatgtaccagttctccctagactggtttcatcaggtttttgtttcatcagtagtttccaaaagcaaagaacaagaacatagttttaaaagggagaaagtgtctccaaaagaagttcatgagtttataagtatttcaaaagaacccaacctggaaaatgagaaaaatctcttagataagcatattaaaagtgcaatagacatgttgacaaaaagtatttttaaggtggtttcttcagctctatttaatgaagataaactttgcttctcttttcggctttgcactgtaatcatgcaaaacaatgctaatggaaatctaatacaggatgacattggattcctaccagaagaagaatggaacatctttttatattctggcatattgataaatattaaaagtgcattatcccagtctagacttactagcacatttgaaataggtgaaagtcaacatcttcagtggctgtcagattccaggtggaggcagtgccaatatgtcagcactcacctggaaccattttcacttctgtgcaaatcccttttatcaaacgtatcacaatgggatacttttaagaacagtaaagcagtttattctctgatcagcacacctttctcttcagaaaatgcttcattggaggaaaatacaaaaccaccagaggaaactgaacttttgaatgaaaataaagaaacgtgtaatcctataaattttccctgggagaaactcacttcatttcaaagacttattttggtaaaagttcttagaccagaaagtttaaacaattcagtgagaaagtttataactgaaaaaatgggaaataagtatcttcaaagaactggagttaatttgaaagatgcatataaaggatccaatgccagaactccgctgatacttattcaaactcatgggatcgaccttaccaatatcctcctgagatttgcacaagagttaaaaggaacaacacatcatgtgaccataatttctctgggccgtgaccaagcagctaaagctgaagacctcattttaaaggcactaacaaaaacacaacaatgggtcttcctccagaactgccatcttgcaacatcatttatgccaaggctttgcacaattgtagaatcttttaatagtccaaacgtgacaatagaccctgagtttcggctatggttaagctcaaaatcatacagttcttttccaattcctgttcttaaaaagggtttaaagattgccgtggaatctccccagggattgaaaagtaacttacttcagacatttggatgtactgggagtggagaggtaacagaagagatatttgaaaatcctgactgtggacaatggtggaaaaaacttttatttagcctatgttttttcaatgctgtaatcaatgaaagaaaaaattacggaatattgggctggaatattgcttataaatttaattcttcagacttgggggttgccattaaggtgttggaaaattccctgagaggacagcccagcatttcgtggcaagcactgcgctacctgattggagaagtgatttacggtggccgggtgattgataattgggacaagcgatgcttgaagaccctactctacaaattttgtaatcctgaagtgctgaaagatgacttcagtttctccagatctgcaagcataaaggactacatacacattatccagtccttacctgatgatgaccttcccgaggtcttaggaatacacccagaggccatcaggagctgctgggagacccagggcgaaaagtttattgaaaatctgattgccatgcaaccaaaaactaccactgccaacctcatgatcagacctgagcagagtaaggatgaactggtgatggaaattctatccgacttgctaaagcggctgccactgacagtggagaaagaagaaattgctgttggaactccaagcacattgaagagcatgatgtcaagctccatttgggagtctctttctaaaaatctcaaagatcacgacccccttatccattgtgtcttgctaacctttttgaagcaagaaattaaacgatttgataagttattatttgtcatacataaatccttaaaagatcttcagcttgctataaaaggagagatcatcctcacccaagaattggaggaaatatttaactcttttcttaatatgagagtgcctacattgtggcagaaacacgcctacagatcttgtaagccactgagttcctggattgatgatctcatccagcgactgaatttcttcaatacttgggccaaagtggcttatactgcaatacagcgtcggtatatgagatttgtcacagtttggaagcagtctattccatcaactagccaaaaatgcaaacaccctgaggattcagagaacaatttctttgaagggtttccttcaagatactggctcccagctttcttctttccacaagcctttcttgctgctgtgcttcaagactatgggaggtcccgaggaatcgctgtggatgccctcaccttcacccaccatgtgatttccaacaccactgacaaggatgagaagttctccgtatttatgccaaagaaactcaacatagtcaggagagcgtttaagggctcagcttcctctcacactggagtttacatttttggtttattcatcgagggggcaagatggaatcgtgaacagaaaatactggaagactcgctgcctctggagatgtgctgtgattttcccgacatatactttttgccaacaaagatttctaccaaaacaccaaatgcttccaaccagacagattcagaactctatgcttttgaatgcccagtttaccagacacctgagaggtcaagaattttggcaactaccggtttaccaacaaactttttaacatcagtgtatttatcaacgaagaaacctcctagtcactggatcacaatgcgggttgcattgctttgtgagaagaatgaaaaataa

SEQ ID NO: 128518 - DNA, 898 bp, Homo sapiens
  Payload ID: 5154
  Gene Symbol: DNAH14
  Gene Name: dynein, axonemal, heavy chain 14
  ENST ID: ENST00000450490
  CDS Start-End: 1-898
gcactggggtcagtcacagggcagacggagaaaggggaactgtgggcatcaacctaccaactggtgaatgttccatctttggatattttgtggatatagagcaatgtgaattcataccttggtcagatttagttcctaatgatcagacactaattcaaagaggaacttcattactaactaatcttcaaagatctggcggaaacttcttgaagataacagaatgtggagaatgcattaattataccgctaccagagacacaacatgcctttcttttctcatgagccttcttttaaagaattcctgccctgtacttctcacaggagaatctggtgttgggaaaactgctgccattaatcaaatgcttgaaaagctagagggtccaggagcatttgacataaaacatggttcaattttaggagacaccctattatatagtgaaataaaaaaatcaagtagcctaaaacagaatatcaccatcttgattcctgaaactcataagacagcaactggaagttcagataatcccactaaaaagccagaagttagaactaataaaaagttacttaaaaataatgatcataaaggagttgtagtctctacaataaattttagcaccaatgtaacagctgccaaaaccaaggagatgattcttaagaagttaataagaagaactaaagatactcttggagcaccaaaaaacaaccggattctaatatttattgatgatatgaatatgccagtatcagatatgtatggagcacagccacccctggaattgataagacaattgttagatttgggaggagtttatgatactgaaaaaaatacatggaagaatattcaagatctgtctatagttgcagcttgtgttccagttgtgaatgatatcagcccacg

SEQ ID NO: 128519 - DNA, 10524 bp, Homo sapiens
  Payload ID: 5154
  Gene Symbol: DNAH14
  Gene Name: dynein, axonemal, heavy chain 14
  Uniprot ID: Q0VDD8
  ENST ID: ENST00000445597
  CDS Start-End: 1-10524
atggggaggcgatcacagtggatctgggctatgaggtgtcagatgctggtaccagtcctaagtctgcacataggactggctcgtgctctgggatgtggctgcattgcttccaagatagaatgcctcataagatgtaatgcaccctttcctctgctggatgctgttggttctgtggcatcacaggagttgcagtctctgactggcaccgtcggtgtcacatcgggggccgccgcgtacccgcggtggaatctcgcaagagccagggcccctcctcacctgcccggcacccaggatcccttgcgccgcgttcgggaccccacccccattgtggcctcttcgccagggcgcaggcgtggctcttggtcaggcggttacggccaggaggcgtcggagcctggcgtggtagggctgtgctgcgcggtccttcccattcaccctagtctggcgctcgccggcgtgggcgggccggaccttcgccgcttccaggaagggccacaacggccgtcggaccacggcgcggcggaaaaacatatggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaagctggatagttctcgaacatattctctagatgaattttgtgaagagcagttacagcaagctacccaggcattgaaacaacttgaggacatcaggaataaagcaatttcagagatgaaaagtacttttctaaaggttgcagaaaagaatgaaatcaaagagtattttgagtcaaaactctctgaagatgacacaacacatttcaagctgcctaaatatagacgtttattagaaacatttttcaagtttgtaatgctggttgactacatatttcaggaactcattcgtcaacttatgaacactgcagtcacactacttttggaattatttaatggttctgctggaatgccattttcagtggaaaaaaagaatgaaaatcttatcagaacattcaaggacaactcttttcctactggaaagacaacaaatgattgtgaagaacttgttgataattcaaagttacatgctatttctgttcaaaagtcagaagtaaaaacagacactgatattaatgagattttgaatagtgttgaagtggggaaggatttgagaaaaacatatgcaccaatatttgaagtaaatctatgcttgagaattcctgctgagagtgattcttcagaaaattctaaagagaactttcatgagtctgaccagtgccctgaagagtgtgtgatgtttgaagatgaaatgtcagaaaataaagacaattgtgtcaaaaaacactcaagtgaagaattgctcccaaaagccaagaaatcaaaagaaattagttacaatcttgaagatattatttcagccacaattactcctctttgccaagatccccagctgtctatcttcattgatttggtttcaataatggatttacctaataagacaggaagcataatacattataaagagcagaccagatggccagattgtcacatcctttttgaaacagatcctgcctaccaaaatataattgtgaatctcctgactattattggtaattcaatgggcctagttaatgcttacagccacaagtttataaagtattgtaccatgacagaaaaggccaaaatcatgagtatgaaaatatcatctatgggagaattaacttcaaaagaatttgaagctattctaaatagattcagaaactattttagacatattgtgaatatggccattgagaagcgtattggtattttcaacgttgttgtggaatcatcattgcagcagctggaatgtgatcccactgaaatagaagaatttctggagcattttatttttttgaatgcaatttcctcaaaaatatctaaattagaaaaagagttcttaacaatgtctcagctatattctgttgcaaagcatcaccagatccatatttcagaagagcaaattgccatattccaagttcttcttcttaagtttagtcaactaaaatcatctatgaagttaagtaaaataaataaagacactgctataactaaattcagagataacttggaagcatgtatcagtggtctacatgttgatgttggcaatttaaaagccaagataagaactcctcttctgttatgtgctggtactcaagtgtcaacagcaatggaaatgatccagactctctcaggggaagctgcaagtttaactaacaaagctaaagcatattcacattatcaggattgtttcagtgattctcaatctcatatgcattctgttaatgtggaagaaattacacagattgtgctttcagagatctctgacattgaaggtgacttgactttgaggaaaaaactatgggaagcacaagaggagtggaagcgagcctcttgggaatggaggaatagttctcttcaaagtattgatgtagaatcagtacagagaaatgtttcaaaactgatgcacataatctcggtactagaaaaagagatttactctatcttcataattccatctatagatgacatatcagctcagttagaagagtctcaagtcatacttgcaacaattaaaggatctccccacattgggcccattaagagccagatcatgttttataatgattgtgttaaaagttttgtgagttcttattcaagagaaaaattggaaaaagtccacgctggtctgatgtgtcatctagaagaggttgcagacctggtagtgctggatactagtaactctcgaacaaaagctatactaggggcattgcttatcctttatgttcactgcagagatatagtgataaatttactacttaaaaatatcttcaatgcagaggattttgagtggacaagacatttgcaatataaatggaatgaaaaacaaaagttgtgctatgtgtctcaaggaaatgccagctttacttatggctatgagtacttgggctgtacctcaagattggttattacgcctctcacagaccgatgctggctgactctcatggaagcactacacttgaatctaggaggctgtcctgccggtccagctggtacaggaaaaactgagactgtcaaagatctagcaaaatgtgctctgtttgcatttaaatgtaacacagccttaataaagcttccaaactcacttatagttttaacatgctttggactagagaaaacagtgctagtgatgaatactgtaatgtcttttaggtttgtactggaaggaaaagaaattcgtatcaatatgtcttgtgcggtatttatcaccatgaatcccagatacggaggtggagtagagctcccagataacttaaaatctctgtttcgcccagtggcaatgatggtgccccattatcaaatgattgctgaaataatattgttttcatttggtttcaaatctgcaaattcactctctggaaagctaactaacctttatgaattagcgcgcaaacagctctcacaacaggatcattataattttggcttgagatctctgaagatagttttaataatggctggaacgaagaaacgggagtttaaatgtgataccagtgacagtctttctgaagcagatgaaaccttgattgttatcgaggctataagagaagctagtttgccaaaatgtcctcctgaagatgtcccactttttgaaaatattataggagatatttttccagaagtgacagttttgaaagtaaatcaacttgccttggagaaagtaatatatactgcaactcagcaattgggtttacaaaactggtcatctcagaaagagaagattatacagttttataatcaacttcaggtttgtgttggtgtgatgttagtgggcccaacaggtggaggaaagacaacagtcagaagaattttggaaaaagcattaacgctattaccaattgcagacttcttatcagttgcagaaagaaaatctgcttcaaagatttcagaaagaaaaggaaaagtagatatttgtgttttaaatccaaagtgtgtcactctcagtgaactatatggacaactggatcctaatactatggaatggactgatggattattatcagcaacaattcgaagttatgtatattttaacacaccaaagaacacaaagaaagacattgatctcagactaaagtcaagaatctcagatttatccaatgttttcaaacttgattcctctgatacaacagagactgatgataatatttttgaggagatagagaaagttgttaaaattccagaaaatcacaattttgattggcagtggattatcctagatggcccagtggacaccttttgggtagaaaatctgaactctgtgctagatgatactagaacattgtgcctagcaaacagtgagagaatagctttaactaataaaataagagtgatttttgaagtggacaatctctctcaggccagtcctgctactgtcagccgatgtgccatggtctatatggatcctgttgatctgggatgggaaccttatgttaagtcatggcttctgaaaacttctaaaattataagtcaatcaggagtggattgtcttgaattcatgattaaaaatagtgtcacagacggactacaatttataaggaatcgtcagaaatttcagccatatcctatggaggacataacagtcgtcataaccctctgcagaattcttgatgctttctttgacttcatgggtaaaaatggaggatttgaacaaagtgatgatttgaatgacacgtcatctaaggaggcaaattcccaaagagagtctgtcacattcaaggatatagaaaagagggatgaaaatacatggtatccagagaaaaatcctgataaattaacaaaaattattcaaaagctttttgtgtttgcctttacttgggcatttggaggagctttaaaccgtgaagatgaacacagagaaaatataccattttgtcccagtcttgaacctgattctcttgcaaaagtaacatacgattttgacaaacttgttcatgaattatttggaaacagttcacaagtaggcatcaacctaccaactggtgaatgttccatctttggatattttgtggatatagagcaatgtgaattcataccttggtcagatttagttcctaatgatcagacactaattcaaagagataatcccactaaaaagccagaagttagaactaataaaaagttacttaaaaataatgatcataaaggagttgtagtctctacaataaattttagcaccaatgtaacagctgccaaaaccaaggagatgattcttaagaagttaataagaagaactaaagatactcttggagcaccaaaaaacaaccggattctaatatttattgatgatatgaatatgccagtatcagatatgtatggagcacagccacccctggaattgataagacaattgttagatttgggaggagtttatgatactgaaaaaaatacatggaagaatattcaagatctgtctatagttgcagcttgtgttccagttgtgaatgatatcagcccacgtcttctcaaacacttttccatgctggtattacctcatccttcacaagacatcttatgtactattttccagattggaatagatggatgtgggaaaaaaacatgtgcaaccttggcctgttatttgacagataataaactataccgagtgcctatatctcacaaatgtgcctacatcgaattcaaagaagtctttaaaaaggtgtttattcacgcaggattaaaagggaaacccactgttctgatggttcccaatttaaacatagaacaagactcatttttagaagatttgaactacatcatcagttcaggaagaatacctgacctgtttgaaaatgttgagctggattctattgcaatgaaaatcagatatcttactgaacaatctggtcatatggataataggcaatctttactttcattctttcaaaagagaatatataaaaatcttcatatttttgtgatcatgagtcctgaaggacctagcttccgccaaaattgtagagtgtatccttctatgattagctcctgcacgatcgattggtatgagaggtggccagaagaagctctccttattgtagctaactcattcttaaaagaaaaggtcaattttgagaacagagagaacttgaaagaaaaacttgccccaacatgtgtccaaatccacaaaagcatgaaagacttgaacagaaaatactttgaagaaactggaagattttattataccactcccaatagctacttgcaatttatggaaacatttgcacacattttgagggcacgagaggaagagatgcaaacaaagagggatcgcttccatatgggtctatccacaatcctggaagcaaccactctagttacagaaatgcaagaagagctcttgattcttggccctcaagtagaacaaaaaacaaaggaaacagaaactctaatggaaaaactacggaaagattcacaagtagttgagaaagttcagatgcttgttaaacaggatgaagaaattgtggcagaagaagtaagaattgtggaagattatgctcagaaaactgccaatgaactaaaaagtgtgctgccagcctttgacaaggcaattgtggctctgaatgccctggataaagctgatgtcgctgaattaagagtatacacacggcctcccttccttgtactgactgtcatgaatgcagtgtgtattcttctgcaaaagaaacctaactgggcaacggcaaagttacttctttcagaaactggtttcctgaaaaaattgattaaccttgacaaggacagcatacctgataaggttttcgtgaagctaaaaaaaattgtaaccttacctgatttcaacccacacaagatttcgctggtttctgttgcttgttgctccctgtgccagtgggttatagctttgaataactaccatgaagtacagaaggttgtgggccctaaacaaatccaagtagctgaagctcaaaacgtccttaaaattgcgcgacaaagacttgctgagaaacaaagaggtttacagctgatcagccgatggcataatcagggactgcctcatggtcagtattcagtagagaatgccatcttgatcaagaatggccagcagtggccactgctgattgacccacataggcaagctcacaaatggatccgtcagatggaaggatccaggctgcagaagctctccattgaagacagcaattataccaaaaaaattgaaaatgctatgaagacaggagggagtgtcctcctgcagtcctgtcaagcttctacatggaggaaaaagttatacttatctacagaaatagacaacccccattttcttccatcagtttataactttgttactatgatcaacttcactgtaacattccaaggtttgcaagatcaactcttgtctactgtggtaactcatgaagttcctcatttagaagatcaacgttccaagttactggagagtatttcccttgatgccataactcttgaagaactagaggaaaaaacattaaatttactgcagaaagcactaggatccatattagatgatgacaaaattgtagataccttaagaaaatccaaaatgacatcaaacgaaatttcaaagcgcatcgaagcaacaaaaaaagctgaaagtgaaatccaagcaatacgtaaaaactatctccccattgcgacccgaggcgccctgctctacttcctagtagctgatctcacacaaatcaactacatgtaccagttctccctagactggtttcatcaggtttttgtttcatcagtagtttccaaaagcaaagaacaagaacatagttttaaaagggagaaagtgtctccaaaagaagttcatgagtttataagtatttcaaaagaacccaacctggaaaatgagaaaaatctcttagataagcatattaaaagtgcaatagacatgttgacaaaaagtatttttaaggtggtttcttcagctctatttaatgaagataaactttgcttctcttttcggctttgcactgtaatcatgcaaaacaatgctaatggaaatctaatacaggatgacattggattcctaccagaagaagaatggaacatctttttatattctggcatattgataaatattaaaagtgcattatcccagtctagacttactagcacatttgaaataggtgaaagtcaacatcttcagtggctgtcagattccaggtggaggcagtgccaatatgtcagcactcacctggaaccattttcacttctgtgcaaatcccttttatcaaacgtatcacaatgggatacttttaagaacagtaaagcagtttattctctgatcagcacacctttctcttcagaaaatgcttcattggaggaaaatacaaaaccaccagaggaaaaacatactttctgcctgcttctccgtgccataaaccatacaggaacagaccttggtcctgtagggagaggccaatggctgaccagcactgcttgtgacaggcacactgacgtgtgtagcttcagttttgctttaaatgatggagtcccagatgttgaacatgttcaggacatattttatggtcattgtgtagacaaatatcatgtaaaagttcttagaccagaaagtttaaacaattcagtgagaaagtttataactgaaaaaatgggaaataagtatcttcaaagaactggagttaatttgaaagatgcatataaaggatccaatgccagaactccgctgatacttattcaaactcatggatctgcaagcataaaggactacatacacattatccagtccttacctgatgatgaccttcccgaggtcttaggaatacacccagaggccatcaggagctgctgggagacccagggcgaaaagtttattgaaaatctgattgccatgcaaccaaaaactaccactgccaacctcatgatcagacctgagcagagtaaggatgaactggtgatggaaattctatccgacttgctaaagcggctgccactgacagtggagaaagaagaaattgctgttggaactccaagcacattgaagagcatgatgtcaagctccatttgggagtctctttctaaaaatctcaaagatcacgacccccttatccattgtgtcttgctaacctttttgaagcaagaaattaaacgatttgataagttattatttgtcatacataaatccttaaaagatcttcagcttgctataaaaggagagatcatcctcacccaagaattggaggaaatatttaactcttttcttaatatgagagtgcctacattgtggcagaaacacgcctacagatcttgtaagccactgagttcctggattgatgatctcatccagcgactgaatttcttcaatacttgggccaaagtggcttatactgcaatacagcgtcggtatatgagatttgtcacagtttggaagcagtctattccatcaactagccaaaaatgcaaacaccctgaggattcagagaacaatttctttgaagggtttccttcaagatactggctcccagctttcttctttccacaagcctttcttgctgctgtgcttcaagactatgggaggtcccgaggaatcgctgtggatgccctcaccttcacccaccatgtgatttccaacaccactgacaaggatgagaagttctccgtatttatgccaaagaaactcaacatagtcaggagagcgtttaagggctcagcttcctctcacactggagtttacatttttggtttattcatcgagggggcaagatggaatcgtgaacagaaaatactggaagactcgctgcctctggagatgtgctgtgattttcccgacatatactttttgccaacaaagatttctaccaaaacaccaaatgcttccaaccagacagattcagaactctatgcttttgaatgcccagtttaccagacacctgagaggtcaagaattttggcaactaccggtttaccaacaaactttttaacatcagtgtatttatcaacgaagaaacctcctagtcactggatcacaatgcgggttgcattgctttgtgagaagaatgaaaaataa

SEQ ID NO: 128520 - DNA, 589 bp, Homo sapiens
  Payload ID: 5154
  Gene Symbol: DNAH14
  Gene Name: dynein, axonemal, heavy chain 14
  ENST ID: ENST00000433124
  CDS Start-End: 1-380
cattggaatataaaacagttagaacattctctgaatctttgaagtcagagaaaacagaagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaagagatacttggtcatttgtggagcagtttatatataagaatctccttgggagcatgttatttaatagtgaagtttttccttttgtgtagagatttaggtttgaagattcaactttaataaattttttcatctatcaaatactttgttaatacttggggtaaatttttacaggaagaactacaaaacaagcatttgctagcttaatgggaactataataataaagaaaagaatattctttattggca

SEQ ID NO: 128521 - DNA, 13763 bp, Homo sapiens
  Payload ID: 5154
  Gene Symbol: DNAH14
  Gene Name: dynein, axonemal, heavy chain 14
  Uniprot ID: Q0VDD8
  ENST ID: ENST00000430092
  CDS Start-End: 216-13763
agggcgcaggcgtggctcttggtcaggcggttacggccaggaggcgtcggagcctggcgtggtagggctgtgctgcgcggtccttcccattcaccctagtctggcgctcgccggcgtgggcgggccggaccttcgccgcttccaggaagggccacaacggccgtcggaccacggcgcggcggccagttcctttatagttttgttcagaaaaacatatggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaaggttattaatatagttggtagtgtaaaggaagtagaactcatacctactttggaatggctatcagaaagaagacattactatttattacggcaattcaagatattttctgatttccgaatgaataaagcatttgttacctggaaattgaatgttaaaagaattaagacagagaagagcaggtcatttttgtaccaccatctttttttggctgatgacttgtttcaaacctgtttggtttatataagaggactttgtgaagatgcaattaatctcaaaaattataatgaccatgaaaataatctatctgccatatgccttgtaaagctggatagttctcgaacatattctctagatgaattttgtgaagagcagttacagcaagctacccaggcattgaaacaacttgaggacatcaggaataaagcaatttcagagatgaaaagtacttttctaaaggttgcagaaaagaatgaaatcaaagagtattttgagtcaaaactctctgaagatgacacaacacatttcaagctgcctaaatatagacgtttattagaaacatttttcaagtttgtaatgctggttgactacatatttcaggaactcattcgtcaacttatgaacactgcagtcacactacttttggaattatttaatggttctgctggaatgccattttcagtggaaaaaaagaatgaaaatcttatcagaacattcaaggacaactcttttcctactggaaagacaacaaatgattgtgaagaacttgttgataattcaaagttacatgctatttctgttcaaaagtcagaagtaaaaacagacactgatattaatgagattttgaatagtgttgaagtggggaaggatttgagaaaaacatatgcaccaatatttgaagtaaatctatgcttgagaattcctgctgagagtgattcttcagaaaattctaaagagaactttcatgagtctgaccagtgccctgaagagtgtgtgatgtttgaagatgaaatgtcagaaaataaagacaattgtgtcaaaaaacactcaagtgaagaattgctcccaaaagccaagaaatcaaaagaaattagttacaatcttgaagatattatttcagacacagaaattgagactgagtttgagaataaatacatgtattatgaatttccagaatttcctacaaatctctttatagatcccaacagattggagttttcagtaaaaattcaaaatatgttgactaatatggaaaaatgtataaccacaattactcctctttgccaagatccccagctgtctatcttcattgatttggtttcaataatggatttacctaataagacaggaagcataatacattataaagagcagaccagatggccagattgtcacatcctttttgaaacagatcctgcctaccaaaatataattgtgaatctcctgactattattggtaattcaatgggcctagttaatgcttacagccacaagtttataaagtattgtaccatgacagaaaaggccaaaatcatgagtatgaaaatatcatctatgggagaattaacttcaaaagaatttgaagctattctaaatagattcagaaactattttagacatattgtgaatatggccattgagaagcgtattggtattttcaacgttgtaagtcttgattatcaatcagaatgcttactgtatattgacaacgtcatacatatgagccacaccctcatacaatctgtaattgaaaaaaagaacaaaaatttattggaagttgtggaatcatcattgcagcagctggaatgtgatcccactgaaatagaagaatttctggagcattttatttttttgaatgcaatttcctcaaaaatatctaaattagaaaaagagttcttaacaatgtctcagctatattctgttgcaaagcatcaccagatccatatttcagaagagcaaattgccatattccaagttcttcttcttaagtttagtcaactaaaatcatctatgaagttaagtaaaataaataaagacactgctataactaaattcagagataacttggaagcatgtatcagtggtctacatgttgatgttggcaatttaaaagccaagataagaactcctcttctgttatgtgctggtactcaagtgtcaacagcaatggaaatgatccagactctctcaggggaagctgcaagtttaactaacaaagctaaagcatattcacattatcaggattgtttcagtgattctcaatctcatatgcattctgttaatgtggaagaaattacacagattgtgctttcagagatctctgacattgaaggtgacttgactttgaggaaaaaactatgggaagcacaagaggagtggaagcgagcctcttgggaatggaggaatagttctcttcaaagtattgatgtagaatcagtacagagaaatgtttcaaaactgatgcacataatctcggtactagaaaaaggtttacctaaaagcgatatggtaacacatcttaagcaagtggtaacagagtttaaacaagagctgcctatcattatagctctgggaaatccctgtctcaagccaaggcattgggaggctctccaggagattattgggaagtcagttccgcttgataaaaactgtaaagtagagaatcttctagctctcaagatgtttcagtatgaaaatgaaataaatgatatgtcaacctcagcaactaatgaagctgctcttgaaaaaatgctatttaagattattgatttttggaacactactcctttgcctttaattcttcaccacacagagatttactctatcttcataattccatctatagatgacatatcagctcagttagaagagtctcaagtcatacttgcaacaattaaaggatctccccacattgggcccattaaggatcttgtgaatgaatgggatcaaaacttgactctcttctcttacacccttgaggaatggatgaattgtcaaagaaattggctttatcttgaaccagtctttcattcttcagaaatacgaaggcaactcccagcagaaacagaacttttctctcaagtgatttccatgtggaaaaaaataatgtcaaaaatacaaaacaaacagaatgctttgcagataaccacttctgcaggagtccttgaaattctgcaaaattgtaatatacatcttgaacatataaagaaaagccttgaggattaccttgaagttaaaagattaattttcccaagattttactttcttagcaatgccgagcttcttgatattctagctgatagcagaaatcctgagtctgtacagcctcatcttgtgaaatgctttgaaaatataaaacaattattgatatggaaacaagacattggccctcctgctgtaaaaatgctaatatctgctgaaggggaaggtctcgtgctgccaaagaaaattcgtgtaagaagtgctgtagaacagtggctggtaaatgtagaaaaaagcatgttcgatgtgctaaaaaaagagagatatatatataacattatcttactttttcagagccagatcatgttttataatgattgtgttaaaagttttgtgagttcttattcaagagaaaaattggaaaaagtccacgctggtctgatgtgtcatctagaagaggttgcagacctggtagtgctggatactagtaactctcgaacaaaagctatactaggggcattgcttatcctttatgttcactgcagagatatagtgataaatttactacttaaaaatatcttcaatgcagaggattttgagtggacaagacatttgcaatataaatggaatgaaaaacaaaagttgtgctatgtgtctcaaggaaatgccagctttacttatggctatgagtacttgggctgtacctcaagattggttattacgcctctcacagaccgatgctggctgactctcatggaagcactacacttgaatctaggaggctgtcctgccggtccagctggtacaggaaaaactgagactgtcaaagatctagcaaaatccttaggcaaacattgtgtggtcttcaactgttttgaggatttggattataagatagtgagaaaatttttctttggactagttcagtcaggagcatggagttgttttgatgaattcaatctaattgatttggaagttctctctgtcattgcctcacagatcctaacaattaaggctgcaaaagacaactattctgccaggtttgtactggaaggaaaagaaattcgtatcaatatgtcttgtgcggtatttatcaccatgaatcccagatacggaggtggagtagagctcccagataacttaaaatctctgtttcgcccagtggcaatgatggtgccccattatcaaatgattgctgaaataatattgttttcatttggtttcaaatctgcaaattcactctctggaaagctaactaacctttatgaattagcgcgcaaacagctctcacaacaggatcattataattttggcttgagatctctgaagatagttttaataatggctggaacgaagaaacgggagtttaaatgtctttctgaagcagatgaaaccttgattgttatcgaggctataagagaagctagtttgccaaaatgtcctcctgaagatgtcccactttttgaaaatattataggagatatttttccagaagtgacagttttgaaagtaaatcaacttgccttggagaaagtaatatatactgcaactcagcaattgggtttacaaaactggtcatctcagaaagagaagattatacagttttataatcaacttcaggtttgtgttggtgtgatgttagtgggcccaacaggtggaggaaagacaacagtcagaagaattttggaaaaagcattaacgctattaccaattgcagacttcttatcagttgcagaaagaaaatctgcttcaaagatttcagaaagaaaaggaaaagtagatatttgtgttttaaatccaaagtgtgtcactctcagtgaactatatggacaactggatcctaatactatggaatggactgatggattattatcagcaacaattcgaagttatgtatattttaacacaccaaagaacacaaagaaagacattgatctcagactaaagtcaagaatctcagatttatccaatgttttcaaacttgattcctctgatacaacagagactgatgataatatttttgaggagatagagaaagttgttaaaattccagaaaatcacaattttgattggcagtggattatcctagatggcccagtggacaccttttgggtagaaaatctgaactctgtgctagatgatactagaacattgtgcctagcaaacagtgagagaatagctttaactaataaaataagagtgatttttgaagtggacaatctctctcaggccagtcctgctactgtcagccgatgtgccatggtctatatggatcctgttgatctgggatgggaaccttatgttaagtcatggcttctgaaaacttctaaaattataagtcaatcaggagtggattgtcttgaattcatgattaaaaatagtgtcacagacggactacaatttataaggaatcgtcagaaatttcagccatatcctatggaggacataacagtcgtcataaccctctgcagaattcttgatgctttctttgacttcatgggtaaaaatggaggatttgaacaaagtgatgatttgaatgacacgtcatctaaggaggcaaattcccaaagagagtctgtcacattcaaggatatagaaaagagggatgaaaatacatggtatccagagaaaaatcctgataaattaacaaaaattattcaaaagctttttgtgtttgcctttacttgggcatttggaggagctttaaaccgtgaagatgaacacagagaaaatataccattttgtcccagtcttgaacctgattctcttgcaaaagtaacatacgattttgacaaacttgttcatgaattatttggaaacagttcacaagtaggatggaagcactggggtcagtcacagggcagacggagaaaggggaactgcatcaacctaccaactggtgaatgttccatctttggatattttgtggatatagagcaatgtgaattcataccttggtcagatttagttcctaatgatcagacactaattcaaagaggaacttcattactaactaatcttcaaagatctggcggaaacttcttgaagataacagaatgtggagaatgcattaattataccgctaccagagacacaacatgcctttcttttctcatgagccttcttttaaagaattcctgccctgtacttctcacaggagaatctggtgttgggaaaactgctgccattaatcaaatgcttgaaaagctagagggtccaggagcatttgacataaaacatggttcaattttaggagacaccctattatatagtgaaataaaaaaatcaagtagcctaaaacagaatatcaccatcttgattcctgaaactcataagacagcaactggaagttcagataatcccactaaaaagccagaagttagaactaataaaaagttacttaaaaataatgatcataaaggagttgtagtctctacaataaattttagcaccaatgtaacagctgccaaaaccaaggagatgattcttaagaagttaataagaagaactaaagatactcttggagcaccaaaaaacaaccggattctaatatttattgatgatatgaatatgccagtatcagatatgtatggagcacagccacccctggaattgataagacaattgttagatttgggaggagtttatgatactgaaaaaaatacatggaagaatattcaagatctgtctatagttgcagcttgtgttccagttgtgaatgatatcagcccacgtcttctcaaacacttttccatgctggtattacctcatccttcacaagacatcttatgtactattttccaggctcatttgggaatttatttctccatcaataacttcacacctgaagttcagaaaagtaaggatcagataatatcttgttccctagctatataccatcaagtacgtcagaatatgttaccaactccaacaaaatgtcactacatgtttaatcttcgagatatgtttaagcttctcctaggattgctgcaagctgacaggactgttgttaactccaaagagatggctgctctgctctttgttcatgaagccacccgagtatttcacgatcgcttaattgatttcactgataaaagccttttctatcggttgctttcaagggaacttgagaactgttttcagattggaatagatggatgtgggaaaaaaacatgtgcaaccttggcctgttatttgacagataataaactataccgagtgcctatatctcacaaatgtgcctacatcgaattcaaagaagtctttaaaaaggtgtttattcacgcaggattaaaagggaaacccactgttctgatggttcccaatttaaacatagaacaagactcatttttagaagatttgaactacatcatcagttcaggaagaatacctgacctgtttgaaaatgttgagctggattctattgcaatgaaaatcagatatcttactgaacaatctggtcatatggataataggcaatctttactttcattctttcaaaagagaatatataaaaatcttcatatttttgtgatcatgagtcctgaaggacctagcttccgccaaaattgtagagtgtatccttctatgattagctcctgcacgatcgattggtatgagaggtggccagaagaagctctccttattgtagctaactcattcttaaaagaaaaggtcaattttgagaacagagagaacttgaaagaaaaacttgccccaacatgtgtccaaatccacaaaagcatgaaagacttgaacagaaaatactttgaagaaactggaagattttattataccactcccaatagctacttgcaatttatggaaacatttgcacacattttgagggcacgagaggaagagatgcaaacaaagagggatcgcttccatatgggtctatccacaatcctggaagcaaccactctagttacagaaatgcaagaagagctcttgattcttggccctcaagtagaacaaaaaacaaaggaaacagaaactctaatggaaaaactacggaaagattcacaagtagttgagaaagttcagatgcttgttaaacaggatgaagaaattgtggcagaagaagtaagaattgtggaagattatgctcagaaaactgccaatgaactaaaaagtgtgctgccagcctttgacaaggcaattgtggctctgaatgccctggataaagctgatgtcgctgaattaagagtatacacacggcctcccttccttgtactgactgtcatgaatgcagtgtgtattcttctgcaaaagaaacctaactgggcaacggcaaagttacttctttcagaaactggtttcctgaaaaaattgattaaccttgacaaggacagcatacctgataaggttttcgtgaagctaaaaaaaattgtaaccttacctgatttcaacccacacaagatttcgctggtttctgttgcttgttgctccctgtgccagtgggttatagctttgaataactaccatgaagtacagaaggttgtgggccctaaacaaatccaagtagctgaagctcaaaacgtccttaaaattgcgcgacaaagacttgctgagaaacaaagaggtttacagctggttgaagaacatttgctgtttttacaggcagcttacaaagataccgttgctgaaaaacaactattagcaaatcggaaaacaatggccagcaggcgctttcagtgtgcgtcagtcttactaactgtcctggaagatgagaagactcgatggcaagaaacaatcaatcaaatagataacaaattagaaggaattttgggtgacatacttctttcagcagcgtgcattgtctacagtggaattttaacaccagaatttcgccagttgattgtgaataaatgggagacattctgcattgaaaatggcatttctttgtcttccaaattctctttaattaaagttatggcacaaaaatatgagatcagccgatggcataatcagggactgcctcatggtcagtattcagtagagaatgccatcttgatcaagaatggccagcagtggccactgctgattgacccacataggcaagctcacaaatggatccgtcagatggaaggatccaggctgcagaagctctccattgaagacagcaattataccaaaaaaattgaaaatgctatgaagacaggagggagtgtcctcctgcagaatctccttgagacattagctccaggcttaaaggcaattctgaaaaaggatatctatcagaaaaaaggacactatttcataagggttggtgatgctgagttcgaatacaattcaaattttaggttatacttatctacagaaatagacaacccccattttcttccatcagtttataactttgttactatgatcaacttcactgtaacattccaaggtttgcaagatcaactcttgtctactgtggtaactcatgaagttcctcatttagaagatcaacgttccaagttactggagagtatttcccttgatgccataactcttgaagaactagaggaaaaaacattaaatttactgcagaaagcactaggatccatattagatgatgacaaaattgtagataccttaagaaaatccaaaatgacatcaaacgaaatttcaaagcgcatcgaagcaacaaaaaaagctgaaagtgaaatccaagcaatacgtaaaaactatctccccattgcgacccgaggcgccctgctctacttcctagtagctgatctcacacaaatcaactacatgtaccagttctccctagactggtttcatcaggtttttgtttcatcagtagtttccaaaagcaaagaacaagaacatagttttaaaagggagaaagtgtctccaaaagaagttcatgagtttataagtatttcaaaagaacccaacctggaaaatgagaaaaatctcttagataagcatattaaaagtgcaatagacatgttgacaaaaagtatttttaaggtggtttcttcagctctatttaatgaagataaactttgcttctcttttcggctttgcactgtaatcatgcaaaacaatgctaatggaaatctaatacaggatgacattggattcctaccagaagaagaatggaacatctttttatattctggcatattgataaatattaaaagtgcattatcccagtctagacttactagcacatttgaaataggtgaaagtcaacatcttcagtggctgtcagattccaggtggaggcagtgccaatatgtcagcactcacctggaaccattttcacttctgtgcaaatcccttttatcaaacgtatcacaatgggatacttttaagaacagtaaagcagtttattctctgatcagcacacctttctcttcagaaaatgcttcattggaggaaaatacaaaaccaccagaggaaactgaacttttgaatgaaaataaagaaacgtgtaatcctataaattttccctgggagaaactcacttcatttcaaagacttattttggtaaaagttcttagaccagaaagtttaaacaattcagtgagaaagtttataactgaaaaaatgggaaataagtatcttcaaagaactggagttaatttgaaagatgcatataaaggatccaatgccagaactccgctgatacttattcaaactcatgggatcgaccttaccaatatcctcctgagatttgcacaagagttaaaaggaacaacacatcatgtgaccataatttctctgggccgtgaccaagcagctaaagctgaagacctcattttaaaggcactaacaaaaacacaacaatgggtcttcctccagaactgccatcttgcaacatcatttatgccaaggctttgcacaattgtagaatcttttaatagtccaaacgtgacaatagaccctgagtttcggctatggttaagctcaaaatcatacagttcttttccaattcctgttcttaaaaagggtttaaagattgccgtggaatctccccagggattgaaaagtaacttacttcagacatttggatgtactgggagtggagaggtaacagaagagatatttgaaaatcctgactgtggacaatggtggaaaaaacttttatttagcctatgttttttcaatgctgtaatcaatgaaagaaaaaattacggaatattgggctggaatattgcttataaatttaattcttcagacttgggggttgccattaaggtgttggaaaattccctgagaggacagcccagcatttcgtggcaagcactgcgctacctgattggagaagtgatttacggtggccgggtgattgataattgggacaagcgatgcttgaagaccctactctacaaattttgtaatcctgaagtgctgaaagatgacttcagtttctccagatctgcaagcataaaggactacatacacattatccagtccttacctgatgatgaccttcccgaggtcttaggaatacacccagaggccatcaggagctgctgggagacccagggcgaaaagtttattgaaaatctgattgccatgcaaccaaaaactaccactgccaacctcatgatcagacctgagcagagtaaggatgaactggtgatggaaattctatccgacttgctaaagcggctgccactgacagtggagaaagaagaaattgctgttggaactccaagcacattgaagagcatgatgtcaagctccatttgggagtctctttctaaaaatctcaaagatcacgacccccttatccattgtgtcttgctaacctttttgaagcaagaaattaaacgatttgataagttattatttgtcatacataaatccttaaaagatcttcagcttgctataaaaggagagatcatcctcacccaagaattggaggaaatatttaactcttttcttaatatgagagtgcctacattgtggcagaaacacgcctacagatcttgtaagccactgagttcctggattgatgatctcatccagcgactgaatttcttcaatacttgggccaaagtggcttatactgcaatacagcgtcggtatatgagatttgtcacagtttggaagcagtctattccatcaactagccaaaaatgcaaacaccctgaggattcagagaacaatttctttgaagggtttccttcaagatactggctcccagctttcttctttccacaagcctttcttgctgctgtgcttcaagactatgggaggtcccgaggaatcgctgtggatgccctcaccttcacccaccatgtgatttccaacaccactgacaaggatgagaagttctccgtatttatgccaaagaaactcaacatagtcaggagagcgtttaagggctcagcttcctctcacactggagtttacatttttggtttattcatcgagggggcaagatggaatcgtgaacagaaaatactggaagactcgctgcctctggagatgtgctgtgattttcccgacatatactttttgccaacaaagatttctaccaaaacaccaaatgcttccaaccagacagattcagaactctatgcttttgaatgcccagtttaccagacacctgagaggtcaagaattttggcaactaccggtttaccaacaaactttttaacatcagtgtatttatcaacgaagaaacctcctagtcactggatcacaatgcgggttgcattgctttgtgagaagaatgaaaaataa

SEQ ID NO: 128522 - DNA, 681 bp, Homo sapiens
  Payload ID: 5154
  Gene Symbol: DNAH14
  Gene Name: dynein, axonemal, heavy chain 14
  ENST ID: ENST00000428003
  CDS Start-End: 1-658
gagatttgtcacagtttggaagcagtctattccatcaactagccaaaaatgcaaacaccctgaggattcagagaacaatttctttgaagggtttccttcaagatactggctcccagctttcttctttccacaagcctttcttgctgctgtgcttcaagactatgggaggtcccgaggaatcgctgtggatgccctcaccttcacccaccatgtgatttccaacaccactgacaaggatgagaagttctccgtatttatgccaaagaaactcaacatagtcaggagagcgtttaagggctcagcttcctctcacactggagtttacatttttggtttattcatcgagggggcaagatggaatcgtgaacagaaaatactggaagactcgctgcctctggagatgtgctgtgattttcccgacatatactttttgccaacaaagatttctaccaaaacaccaaatgcttccaaccagacagattcagaactctatgcttttgaatgcccagtttaccagacacctgagaggtcaagaattttggcaactaccggtttaccaacaaactttttaacatcagtgtatttatcaacgaagaaacctcctagtcactggatcacaatgcgggttgcattgctttgtgagaagaatgaaaaataaatgtccatatcaaaccattttaa

SEQ ID NO: 128523 - DNA, 478 bp, Homo sapiens
  Payload ID: 5154
  Gene Symbol: DNAH14
  Gene Name: dynein, axonemal, heavy chain 14
  ENST ID: ENST00000495456
  CDS Start-End: 1-207
gctgaaggggaaggtctcgtgctgccaaagaaaattcgtgtaagaagtgctgtagaacagtggctggtaaatgtagaaaaaagcatgttcgatgtgctaaaaaaatttttaagtcaagggattgaagactggaactgccagatgttttcccaatgggtgttatctcatccaggacaagtggtacttactgtgacatttgcaatataaatggaatgaaaaacaaaagttgtgctatgtgtctcaaggaaatgccagctttacttatggctatgagtacttgggctgtacctcaagattggttattacgcctctcacagaccgatgctggctgactctcatggaagcactacacttgaatctaggaggctgtcctgccggtccagctggtacaggaaaaactgagactgtcaaagatctagcaaaatccttaggcaaacattgtgtggtcttcaactgttttgaggatttggattataag

SEQ ID NO: 128524 - DNA, 428 bp, Homo sapiens
  Payload ID: 5154
  Gene Symbol: DNAH14
  Gene Name: dynein, axonemal, heavy chain 14
  ENST ID: ENST00000474801
  CDS Start-End: 1-393
gattaccttgaagttaaaagattaattttcccaagattttactttcttagcaatgccgagcttcttgatattctagctgatagcagaaatcctgagtctgtacagcctcatcttgtgaaatgctttgaaaatataaaacaattattgatatggaaacaagacattggccctcctgctgtaaaaatgctaatatctgctgaaggggaaggtctcgtgctgccaaagtatgataaatgttacaaactgtttagattctgtacaacgtcattatttaaaatctctgctttgaaatttttgatatattataaaagtgcgctaagcaaactgtttcttcaaagattatatccttacgtaaatatacttttgcctttccatattccctacaatacataatctcacctttgctctaattaaaagttgagaaagca

SEQ ID NO: 128525 - DNA, 13723 bp, Homo sapiens
  Payload ID: 5155
  Gene Symbol: DNAH17
  Gene Name: dynein, axonemal, heavy chain 17
  Uniprot ID: Q9UFH2
  ENST ID: ENST00000389840
  CDS Start-End: 126-13514
gtggcagttggagcccctcgagggaagggagccattttctttcctggtttgggaaagagttgctcatcagtttgcgggagaagctgtttgccttcagctgatacacagtgtaaggaaaggccaagatgacaatggccccggacgtcagactagagtatctggaggaagttgcctccatcgtcctgaagttcaagccggacaagtggagcaagctgataggcgccgaggagaacgtggccctgttcacagagttctttgaaaagcccgacgtccaggtgctggtgctgacgctcaatgcagccggcatgatcataccctgcctgggcttcccccagtccctcaagtccaaaggggtttacttcatcaagacaaagtccgagaacatcaacaaggacaactacagggcccggctcctttacggcgacatcagccccacacccgtggaccagctgatcgcggtggtggaggaggtcctctcttctctgttaaaccaaagtgagaacatggctggatggccccaggtggtctcggaagacatcgtgaagcaggtccacaggctgaagaatgaaatgtttgtgatgagtggcaagatcaaaggcaaaaccttgctgcctattccggagcacctgggcagcctggatggcacgctggagtccatggagaggatcccctcttcactggacaacttgctcctgcacgccattgaaaccaccatcatcgactggtcccaccagatccgggatgtgctgagcaaagactcagcccaggcgctgctggatgggctgcaccccctgccccaagtggagttcgagttctgggacactcggctgctgaacctcaagtgcatccatgaacagctaaacagacccaaagtgaacaagattgttgagatcctagagaaagccaaaagctgctactggccagccctgcaaaacgtttacaccaacgtcactgaagggctgaaggaagccaacgacatcgtgctctatttgaagcccctacggatcctgctggaggagatggaacaagccgacttcacgatgctccccaccttcattgccaaggtgctggacaccatctgcttcatctgggccacctctgagtactataacacacctgccaggatcatcgtcatcctgcaggagttctgcaaccaaatcatcgagatgacacgaaccttcctgagcccggaagaggtgctgaagggcctgcaaggtgaaatcgaggaagtcctgagtggcatctccctggctgtaaatgtgctgaaggagctctaccagacgtacgacttctgctgcgtgaacatgaagcttttctttaaggacaaagagcccgtgccttgggaattcccttcttctcttgccttttccaggataaattccttcttccagcgcatccagaccattgaggaactctataaaacagcaattgagtttctgaagctggagaaaatcgagcttgggggcgtgcgtgggaacctcctcgggagcctggtgacccgtatctatgatgaggtctttgagctggtgaaggtttttgccgactgcaaatatgatcccttggaccctggagactcgaattttgaccgtgattatgctgattttgagatcaaaatccaagacctggataggaggctggccacgatcttttgccaaggatttgatgactgcagctgtatcaagtcctccgcaaagctcctgtacatgtgtgggggcctcatggagcggcccctgattcttgccgaggtggcgcccaggtattcagtcatgctggagctgtttgacgctgagctagacaatgctaagatcttgtacgatgcccagatggcggcctccgaggaggggaacatccccctgatccacaaaaacatgcctcccgtggccgggcagctcaaatggagcctggagctgcaggagaggctagaggtgtccatgaaacacctgaagcacgtcgaacacccggtcatgtctggagcagaggccaagctgacctatcagaagtatgacgagatgatggagctgctgaggtgccaccgcgagaagatctaccagcagtgggtggcgggcgtggaccaggactgccactttaacctggggcagccgctgattctgcgggacgccgctagcaacctcatccacgtcaacttcagcaaagcgttggtggcagttctgagagaagtcaagtatttgaatttccagcaacagaaagagattccagacagtgcggagagtctgttctcagagaacgaaactttccggaagtttgtgggcaacctggagctcatcgttggctggtataatgagataaagactatagtgaaggcagtagaatttctactaataaagtcagaactggaagcaattgatgtcaagttattgagcgctgaaacgacattattctggaatggcgaaggtgtgtttcagtacattcaagaggtgcgagaaattctgcacaacttgcagaacaggatgcaaaaggcaaaacaaaatatagaaggaatttcccaggctatgaaggactggtcggccaacccgctgtttgaaagaaaggacaataagaaagaggccctgttagacttggatggaagaattgccaacctcaacaagcgctacgcagcagtcagggatgctggagtgaagatccaagccatggttgcagaaaacgcagaactattcagggcagacacactgagcctgccctggaaggattatgtcatctacattgacgacatggtcttagatgaatttgaccagttcattcgcaaatctctgagtttcctaatggacaacatggttatagatgagagtatcgctcccctgtttgagatccgcatggagctggacgaggatgggctgaccttcaacccgaccctggaggtgggctcagatcgcggcttcctggcactgatcgagggcctggtcaacgacatctacaacgtagccaggctcatccctcggctggccaaggacaggatgaactacaagatggacctggaagataacacagacctcatagagatgagggaggaggtgtccagcctggtcatcaatgccatgaaggaggccgaggagtaccaggattcctttgagaggtactcctacctctggacggacaacctgcaggagtttatgaagaatttcctgatatatgggtgtgcagtcactgcggaggacttggacacctggacagatgacaccatccccaagacaccgcccaccctggctcagttccaggagcagatcgactcctacgagaagctgtatgaggaggtgtccaagtgcgagaacaccaaggtgttccacggctggctgcagtgcgactgccgccccttcaagcaggccctgctcagcacaatccggcgctggggcttcatgttcaagcggcacctgagcaaccacgtcaccaacagcctggctgacctggaagccttcatgaaagtcgccagaatgggcttgaccaagcccctcaaggagggggactatgatgggcttgtggaggtgatggggcacctgatgaaagtcaaggagaggcaagcagccaccgacaacatgtttgagcccctgaagcaaaccatcgagctgctcaagacctacggggaggagatgccagaggagatccacttgaagctgcaggagctgccggagcactgggcaaataccaagaaactggccattcaggtgaagctgaccgtggcaccactccaggccaacgaggtcagcatcctgcggcggaaatgccagcaattcgagctcaagcaacatgagttcagggagaggttcaggcgcgaggccccgttctccttcagcgaccccaacccctacaagtccctgaataagcaacaaaagagcatctccgccatggaaggcatcatggaggcgctgtccaagtccgggggcctgttcgaggtccccgtcccagactacaagcagctcaaggcctgccaccgggaggtccgcctactgaaggagctctgggacatggttgttgtggtaaataccagcatcgaggactggaagaccaccaagtggaaagatatcaacgttgagcagatggacatagattgtaagaagtttgccaaggacatgaggtctttggacaaggagatgaaaacctgggatgccttcgtggggctcgacaacaccgtgaaaaacgtgatcacgtccctgcgtgccgtgagcgagctgcagaaccctgccattcgggaacgccactggcagcagctcatgcaggccacccaggtgaaatttaaaatgtcagaagagacgaccctggcagatttactgcagctgaacctccacagttacgaggatgaggtccgcaacatcgtggacaaggccgtgaaggagtcgggcatggaaaaggtgctgaaagccctggacagtacctggagcatgatggaattccagcacgagccgcacccgcggacaggcaccatgatgctcaagtccagcgaggtgctggtggagacgctggaggacaaccaggtgcagctgcagaacctgatgatgtccaagtacctggcccacttcctgaaggaggtgacaagctggcagcagaagctgtccacggcggactccgtcatctccatctggtttgaggtccagcgaacctggagccacctggagagcatcttcatcggctccgaagacatccgcacccagctcccgggggactcccagcgctttgacgacatcaaccaggaattcaaggccttgatggaagatgcagtgaaaacacccaacgtggtggaagccaccagcaaacccggcctctacaataaactggaggccctgaagaagagcttggccatctgtgaaaaggctttggcagagtatttagagacgaaaagactggctttcccccggttctattttgtctcctcggctgacctcctggacattctctccaatggcaatgaccccgtggaggtgagccgccacctgtccaaactcttcgatagcctgtgtaaactgaagttccggctcgatgccagtgacaaacctctcaaggtgggcctgggaatgtacagcaaggaggacgagtacatggtttttgatcaggaatgcgacctctcggggcaggtggaagtgtggctgaatcgagtgctggaccgaatgtgctctaccctccggcacgaaatcccagaggccgtggtgacctacgaagagaagccgagggagcagtggatcctggactacccagcccaggtggccctgacttgcacccagatctggtggacgaccgaggtgggcctggcatttgccaggctggaggaaggctatgaaaacgctatcagagattataacaaaaagcagattagccagctgaacgtactcatcacgctgctcatggggaacctcaacgctggcgacaggatgaagatcatgaccatctgcaccatcgatgtgcacgcacgggacgtggtggccaaaatgatcgtggccaaggtggagagttctcaggccttcacctggcaggcccagctccggcatcgctgggacgaagagaagcgacactgctttgccaacatctgcgatgcccaaatccagtattcctatgagtatctgggcaacacgccgcggctggtcatcaccccactcactgacaggtgctatatcaccctgacccagtccctccatctcatcatgggtggagcccctgccggccccgctgggaccggcaagactgagacgaccaaggacctgggcagagccctgggcaccatggtctacgtcttcaactgctccgagcagatggactacaagtcctgtggaaatatctacaagggcctggcccagacgggagcctggggctgctttgacgagtttaatcgcatctcagtggaagtcttgtctgtgattgccgtgcaggtaaaatgtgtccaggatgcaattcgggccaagaaaaaagcattcaatttcctgggagagatcataggcctcattcccaccgtcggtatcttcatcaccatgaaccctgggtacgccggacgcgcggagctgcctgagaacctaaaagccttattcaggccctgtgccatggtcgtccccgacttcgaactgatatgtgagatcatgctcatggccgagggctttctggaagcccgccttctggccaggaagttcatcaccctgtacaccttgtgcaaggagctgctctcgaagcaggatcattacgactggggcctgagagccatcaagtctgtgctggtggtggccggctccctgaagaggggcgaccccagccgggcagaggaccaggtgctcatgcgggcgctgagagacttcaacatccccaagattgtgacagacgacctgcccgtattcatgggactgatcggggacctcttcccggctctggacgtgcctcggaaacgggacctgaattttgaaaagatcatcaagcagagcatcgtggagctcaagctgcaggcggaggacagcttcgtgctgaaggtggtgcagctggaggagctgctgcaggtccgccactccgtgttcatcgtcgggaatgcgggcagcggcaaatctcaggtcctcaaatccctcaacaagacctatcagaacctgaagaggaagccggtcgccgtggacctggaccccaaggccgtcacctgcgacgagctctttggcatcatcaacccagtgaccagggaatggaaagatggcctgttctccaccatcatgcgagacctggccaacatcacccatgacggccccaagtggatcatccttgacggagacatagaccccatgtggatcgagtctctcaacacagtcatggatgacaacaaggtcctcaccctggccagcaacgagcggatccccctgaaccgcaccatgaggctggtgttcgaaatcagccacctgaggacggccaccccagccaccgtttccagagccggcatcctctacatcaacccagccgacctgggatggaacccggtggtgagcagctggatcgagaggcgcaaggtgcagtcggagaaggccaacctgatgatcctctttgacaagtacctgcccacgtgcctggacaagttgcgctttgggttcaagaagatcacgccagtgccggagatcacggtgatccaaacgattctgtacctgctggagtgcctgctcacggagaagaccgtgccccccgactcccccagggagctgtacgagctgtacttcgtgttcacctgcttctgggccttcggtggcgccatgttccaggaccagcttgtggattatcgagtggagttcagtaaatggtggatcaacgaattcaagactatcaagttcccctcgcagggaacgatttttgactactacattgatcctgacacaaaaaagttcctgccctggacagataaagtgccctcctttgagctggatcccgatgtcccactgcaggcctctttggtccacaccacggaaaccatccgcatccgctacttcatggacctgctcatggagaagtcctggccggtgatgctggtggggaacgcggggacgggcaagtcggtgctgatgggggacaagctggaaagcctgaacacggacaactacctggtgcaggctgtgcccttcaacttctacacgacctcagccatgctgcagggggtgctggagaagccgctggagaagaaatcggggaggaactacgggccgccaggcactaagaagctcgtctacttcatcgacgacatgaacatgcccgaggtggacaagtatgggacggtggccccgcacaccctcatccggcagcacatggaccaccggcactggtatgacagacataagctgacgttaaaagatatccataattgtcagtacgtggcctgcatgaaccccacttccggatccttcaccatcgactccaggcttcagcgccatttctgcgtgtttgctgtgagcttccccggccaggaggccctcaccaccatctacaacacaatcctgacgcagcacctggccttccgctcggtctccatggctatccagaggataagcagccagctggtggccgcggccctggctttgcatcagaaaatcacggcaacatttcttcccacggccattaagtttcattatgtcttcaacctcagggacctctccaatattttccagggactcttattttccacagcagaagttctgaaaaccccactggacctcgtccgcctttggctacatgagactgaacgagtgtatggtgacaaaatggttgacgaaaaagaccaggaaacattgcatagagtcaccatggcctccaccaagaagttctttgatgatcttggtgatgaactcttatttgccaagccaaatatcttctgccactttgctcaagggattggcgatcccaaatatgttcctgtaaccgacatggctcctctgaacaagctcctcgtggacgtcctggacagctacaatgaagttaatgcagtcatgaatttggtgctgtttgaggacgccgtggctcacatctgcaggattaatcgcatcctggagtctccccgggggaatgccctgctggtgggggtgggcggcagtggcaaacagagcctctcccgcctggcagcgtacatcagcgggcttgacgtgtttcagatcaccctcaagaagggctacgggatccccgacctcaagattgacctcgctgctcagtacataaaggctgccgtgaagaacgttccctcggtgttcctgatgacagactcccaggtggccgaggagcagtttctggtgctgatcaatgacctgctggcctcaggagagatccctgggctgtttatggaggacgaggtggagaacatcatctcctccatgcgaccccaagtcaagtcccttggcatgaatgacactcgggaaacatgttggaagttcttcatcgaaaaagtgcgcagacagctcaaggtgatcctgtgtttctcccctgtgggctccgtgctgcgggtacgagccagaaagttcccagctgtggtcaactgcacggccatcgactggttccacgagtggccggaagatgcgctggtgtccgtcagcgcccgcttcctggaggagactgaggggattccgtgggaagtcaaggcctccatcagcttcttcatgtcctacgtgcacaccaccgtcaacgagatgtccagggtatacctggctactgagaggcgctacaactacaccacacccaaaacctttctggagcagatcaaactgtaccagaacctgctggccaagaagagaacggaacttgttgccaaaatcgagaggctggagaacggcctgatgaagctgcagagcacggcttcccaggtggatgatttgaaagccaagttggcgattcaggaggctgagctcaagcagaagaatgagagcgcagaccaactgatccaggtggtcggcatcgaggccgagaaggtcagcaaagagaaggccattgctgaccaggaagaagtcaaggtcgaggtcatcaataagaacgtcactgagaagcaaaaggcctgtgaaacagacctggccaaagcagaaccggccctgctggcagcccaggaggctctggacactctgaataagaacaacctgacagagctgaagtcctttgggtccccgccggatgctgtggtcaacgtcaccgccgccgtcatgattctgaccgcacctgggggcaagatccccaaggacaagagctggaaggcggccaagatcatgatgggcaaggtggacaccttcctagactccctgaagaagttcgacaaggagcacatccctgaggcctgcctgaaggccttcaagccctaccaaggcaacccgacgttcgaccccgagttcatccgctccaagtccacggccgccgccggcctgtgctcctggtgcatcaacatcgtccgcttctacgaggtctactgcgacgtggcgcccaagaggcaggcactggaggaggctaatgcagagctggcagaggcacaagagaagctgtcccggatcaaaaacaagattgccgaacttaacgccaacctgagcaacctaacctcagcgtttgaaaaagcaacagctgagaaaatcaagtgtcagcaagaggccgatgccacgaacagggtgatcttactggcgaacaggctggtcgggggattagcatcggaaaacatccgctgggctgagtctgtggagaacttcaggagccagggggtcacgctgtgtggggacgtcctgctcatctctgccttcgtgtcctacgtgggctacttcaccaagaaataccggaatgagctgatggagaaattctggatcccttacatacataacttaaaggtccccatcccgatcacgaatggcctggatcccttgagcctgctgacagatgacgcggacgtggccacctggaacaaccagggcctccccagcgaccgcatgtccaccgagaatgccaccatcctgggcaacaccgagcggtggccgctgatcgtggacgcccagctccaaggaatcaagtggatcaaaaacaaatacaggagtgaactgaaagccatccgcctgggacagaagagctacctggatgtcatcgagcaggccatctcggaaggggacaccttgctcattgagaacatcggcgaaaccgtggaccccgtgctggaccctctactgggcaggaacacgattaaaaagggaaagtacattaagatcggtgacaaggaggtggagtaccaccccaagttccgcctgatcctacacaccaagtacttcaacccacactacaagccagagatgcaggctcagtgcaccctcatcaacttcctggtcaccagggatggactcgaggaccaactcttggccgctgtggtggccaaagagcgcccagatctggaacagctgaaggcaaacctcaccaagtctcaaaacgaatttaagattgttctgaaagagctggaagattcgctcctggcccgtctgtcggctgcgtcggggaactttctgggagacacggccttggtggagaatctggagaccaccaagcacacagccagcgagatcgaggagaaggtggtggaggcaaaaatcacagaagttaaaatcaacgaagcgagagagaactaccgcccggctgcggagagggcatctctgctctacttcatactgaacgatctcaacaaaatcaaccccgtctaccagttctccctcaaggccttcaacgtggtgtttgagaaagccatccagaggaccacccctgccaacgaggtgaagcagcgggtgatcaacctgacggacgagatcacctactccgtctacatgtacacggcccggggactcttcgagagggacaaactcattttcctggcacaagttacgtttcaggtcctgtccatgaagaaggagctgaacccagtggagctggatttcctcctgcggttcccttttaaggccggagtggtctcaccagtggacttcctccagcatcaaggctggggcgggatcaaggccctctcggagatggatgagttcaaaaatctggacagtgacatcgaaggatctgccaagcgctggaaaaagctggtggagtcggaagcccccgagaaggagatcttccccaaggagtggaagaacaagacggccctgcagaagctgtgcatggtgcgctgcctgcggccagatcgcatgacctacgctatcaagaacttcgtggaggaaaagatgggcagcaagttcgtggaaggccggagtgttgagttttctaagtcctacgaggagagcagcccctccacgtcaatcttcttcatcctctccccgggggttgaccccttgaaagacgtggaagccctgggaaaaaaactagggtttaccatagacaatggaaaactccataatgtgtccctggggcagggacaagaggtggtggctgagaacgccctggacgtggctgcagagaaaggacactgggtcattctgcagaatatccacctggtggcccggtggctgggaacactggacaagaagctggagcactacagcacgggcagccatgaggactaccgggtgttcatcagcgcggagcctgcccccagccccgagacccacatcatcccccagggcattctggagaacgccatcaagatcaccaacgagccccccacgggcatgcacgccaacttgcacaaggccctggacctgttcacccaggacaccctggagatgtgcaccaaggagatggagttcaagtgcatgctcttcgccctgtgctacttccacgctgtggtggcagagaggcgcaagttcggcgcccagggctggaaccggtcgtaccccttcaacaacggggacctcaccatctccatcaacgtgctctacaactacctggaggccaaccccaaggtgccctgggacgatctccgctacctttttggtgaaatcatgtatggcggccacatcacagatgactgggaccgtcggctgtgcaggacctacctggctgaatacatccggacggagatgctggagggagacgtcctgctggcccccggctttcagatcccccccaacctggactacaagggttaccacgaatacatcgatgagaacctgccccctgagagtccctatctgtatggcctgcaccccaacgcagagattggctttctgacggtcacctcagagaagctgttccgcactgtcctggaaatgcagccaaaagagacggactcgggggcaggcacgggagtgtcccgcgaggagaaggtgaaggccgtgctggacgacatcctggagaagattccggagactttcaacatggctgagatcatggcaaaggcagcggaaaagaccccctacgtggtagtcgcctttcaagaatgtgaaagaatgaacatcctgaccaacgaaatgcgccgttcgctcaaggagctgaacctggggctgaagggagaactgaccatcacgaccgacgtggaagatctgtccacggctctcttctatgacaccgtgcctgatacgtgggtggcccgggcctacccctccatgatgggcctggcggcctggtacgcagacctgctgctccgcatcagggaactcgaggcctggacgacagactttgccctgcccaccaccgtgtggctggccggcttcttcaacccccagtcgttcctcacggccatcatgcagtccatggccaggaagaacgagtggcccctggacaagatgtgtctgtctgtcgaggtgaccaagaaaaaccgagaggacatgaccgctcctccgcgagagggctcctacgtgtacggactcttcatggaaggggctcgctgggacacccagactggagtcatcgctgaagcgcggctgaaagagctgaccccggccatgcctgtcatcttcatcaaggccattcctgtggaccgcatggagaccaagaacatctatgagtgtcccgtgtacaaaacacgcatccgcggccccacctatgtctggacctttaacttgaagaccaaagagaaggcagcgaagtggatcctggcagccgtggcgctgctcctacaggtttagctcgctcctgcctcacagcccacactccctggggctggaccacaactcagcccttcacctgtgcacctgtgacttattctttacaggaactggtggtggtttttcgttctcttaaataatcaggtgctttgtaaccaagcacatcggaaccagagggtggaggttggtgtggaagaggtggggcagattaaagccagtggagccactca

SEQ ID NO: 128526 - DNA, 13708 bp, Homo sapiens
  Payload ID: 5155
  Gene Symbol: DNAH17
  Gene Name: dynein, axonemal, heavy chain 17
  ENST ID: ENST00000585328
  CDS Start-End: 126-13499
gtggcagttggagcccctcgagggaagggagccattttctttcctggtttgggaaagagttgctcatcagtttgcgggagaagctgtttgccttcagctgatacacagtgtaaggaaaggccaagatgacaatggccccggacgtcagactagagtatctggaggaagttgcctccatcgtcctgaagttcaagccggacaagtggagcaagctgataggcgccgaggagaacgtggccctgttcacagagttctttgaaaagcccgacgtccaggtgctggtgctgacgctcaatgcagccggcatgatcataccctgcctgggcttcccccagtccctcaagtccaaaggggtttacttcatcaagacaaagtccgagaacatcaacaaggacaactacagggcccggctcctttacggcgacatcagccccacacccgtggaccagctgatcgcggtggtggaggaggtcctctcttctctgttaaaccaaagtgagaacatggctggatggccccaggtggtctcggaagacatcgtgaagcaggtccacaggctgaagaatgaaatgtttgtgatgagtggcaagatcaaaggcaaaaccttgctgcctattccggagcacctgggcagcctggatggcacgctggagtccatggagaggatcccctcttcactggacaacttgctcctgcacgccattgaaaccaccatcatcgactggtcccaccagatccgggatgtgctgagcaaagactcagcccaggcgctgctggatgggctgcaccccctgccccaagtggagttcgagttctgggacactcggctgctgaacctcaagtgcatccatgaacagctaaacagacccaaagtgaacaagattgttgagatcctagagaaagccaaaagctgctactggccagccctgcaaaacgtttacaccaacgtcactgaagggctgaaggaagccaacgacatcgtgctctatttgaagcccctacggatcctgctggaggagatggaacaagccgacttcacgatgctccccaccttcattgccaaggtgctggacaccatctgcttcatctgggccacctctgagtactataacacacctgccaggatcatcgtcatcctgcaggagttctgcaaccaaatcatcgagatgacacgaaccttcctgagcccggaagaggtgctgaagggcctgcaaggtgaaatcgaggaagtcctgagtggcatctccctggctgtaaatgtgctgaaggagctctaccagacgtacgacttctgctgcgtgaacatgaagcttttctttaaggacaaagagcccgtgccttgggaattcccttcttctcttgccttttccaggataaattccttcttccagcgcatccagaccattgaggaactctataaaacagcaattgagtttctgaagctggagaaaatcgagcttgggggcgtgcgtgggaacctcctcgggagcctggtgacccgtatctatgatgaggtctttgagctggtgaaggtttttgccgactgcaaatatgatcccttggaccctggagactcgaattttgaccgtgattatgctgattttgagatcaaaatccaagacctggataggaggctggccacgatcttttgccaaggatttgatgactgcagctgtatcaagtcctccgcaaagctcctgtacatgtgtgggggcctcatggagcggcccctgattcttgccgaggtggcgcccaggtattcagtcatgctggagctgtttgacgctgagctagacaatgctaagatcttgtacgatgcccagatggcggcctccgaggaggggaacatccccctgatccacaaaaacatgcctcccgtggccgggcagctcaaatggagcctggagctgcaggagaggctagaggtgtccatgaaacacctgaagcacgtcgaacacccggtcatgtctggagcagaggccaagctgacctatcagaagtatgacgagatgatggagctgctgaggtgccaccgcgagaagatctaccagcagtgggtggcgggcgtggaccaggactgccactttaacctggggcagccgctgattctgcgggacgccgctagcaacctcatccacgtcaacttcagcaaagcgttggtggcagttctgagagaagtcaagtatttgaatttccagcaacagaaagagattccagacagtgcggagagtctgttctcagagaacgaaactttccggaagtttgtgggcaacctggagctcatcgttggctggtataatgagataaagactatagtgaaggcagtagaatttctactaataaagtcagaactggaagcaattgatgtcaagttattgagcgctgaaacgacattattctggaatggcgaaggtgtgtttcagtacattcaagaggtgcgagaaattctgcacaacttgcagaacaggatgcaaaaggcaaaacaaaatatagaaggaatttcccaggctatgaaggactggtcggccaacccgctgtttgaaagaaaggacaataagaaagaggccctgttagacttggatggaagaattgccaacctcaacaagcgctacgcagcagtcagggatgctggagtgaagatccaagccatggttgcagaaaacgcagaactattcagggcagacacactgagcctgccctggaaggattatgtcatctacattgacgacatggtcttagatgaatttgaccagttcattcgcaaatctctgagtttcctaatggacaacatggagagtatcgctcccctgtttgagatccgcatggagctggacgaggatgggctgaccttcaacccgaccctggaggtgggctcagatcgcggcttcctggcactgatcgagggcctggtcaacgacatctacaacgtagccaggctcatccctcggctggccaaggacaggatgaactacaagatggacctggaagataacacagacctcatagagatgagggaggaggtgtccagcctggtcatcaatgccatgaaggaggccgaggagtaccaggattcctttgagaggtactcctacctctggacggacaacctgcaggagtttatgaagaatttcctgatatatgggtgtgcagtcactgcggaggacttggacacctggacagatgacaccatccccaagacaccgcccaccctggctcagttccaggagcagatcgactcctacgagaagctgtatgaggaggtgtccaagtgcgagaacaccaaggtgttccacggctggctgcagtgcgactgccgccccttcaagcaggccctgctcagcacaatccggcgctggggcttcatgttcaagcggcacctgagcaaccacgtcaccaacagcctggctgacctggaagccttcatgaaagtcgccagaatgggcttgaccaagcccctcaaggagggggactatgatgggcttgtggaggtgatggggcacctgatgaaagtcaaggagaggcaagcagccaccgacaacatgtttgagcccctgaagcaaaccatcgagctgctcaagacctacggggaggagatgccagaggagatccacttgaagctgcaggagctgccggagcactgggcaaataccaagaaactggccattcaggtgaagctgaccgtggcaccactccaggccaacgaggtcagcatcctgcggcggaaatgccagcaattcgagctcaagcaacatgagttcagggagaggttcaggcgcgaggccccgttctccttcagcgaccccaacccctacaagtccctgaataagcaacaaaagagcatctccgccatggaaggcatcatggaggcgctgtccaagtccgggggcctgttcgaggtccccgtcccagactacaagcagctcaaggcctgccaccgggaggtccgcctactgaaggagctctgggacatggttgttgtggtaaataccagcatcgaggactggaagaccaccaagtggaaagatatcaacgttgagcagatggacatagattgtaagaagtttgccaaggacatgaggtctttggacaaggagatgaaaacctgggatgccttcgtggggctcgacaacaccgtgaaaaacgtgatcacgtccctgcgtgccgtgagcgagctgcagaaccctgccattcgggaacgccactggcagcagctcatgcaggccacccaggtgaaatttaaaatgtcagaagagacgaccctggcagatttactgcagctgaacctccacagttacgaggatgaggtccgcaacatcgtggacaaggccgtgaaggagtcgggcatggaaaaggtgctgaaagccctggacagtacctggagcatgatggaattccagcacgagccgcacccgcggacaggcaccatgatgctcaagtccagcgaggtgctggtggagacgctggaggacaaccaggtgcagctgcagaacctgatgatgtccaagtacctggcccacttcctgaaggaggtgacaagctggcagcagaagctgtccacggcggactccgtcatctccatctggtttgaggtccagcgaacctggagccacctggagagcatcttcatcggctccgaagacatccgcacccagctcccgggggactcccagcgctttgacgacatcaaccaggaattcaaggccttgatggaagatgcagtgaaaacacccaacgtggtggaagccaccagcaaacccggcctctacaataaactggaggccctgaagaagagcttggccatctgtgaaaaggctttggcagagtatttagagacgaaaagactggctttcccccggttctattttgtctcctcggctgacctcctggacattctctccaatggcaatgaccccgtggaggtgagccgccacctgtccaaactcttcgatagcctgtgtaaactgaagttccggctcgatgccagtgacaaacctctcaaggtgggcctgggaatgtacagcaaggaggacgagtacatggtttttgatcaggaatgcgacctctcggggcaggtggaagtgtggctgaatcgagtgctggaccgaatgtgctctaccctccggcacgaaatcccagaggccgtggtgacctacgaagagaagccgagggagcagtggatcctggactacccagcccaggtggccctgacttgcacccagatctggtggacgaccgaggtgggcctggcatttgccaggctggaggaaggctatgaaaacgctatcagagattataacaaaaagcagattagccagctgaacgtactcatcacgctgctcatggggaacctcaacgctggcgacaggatgaagatcatgaccatctgcaccatcgatgtgcacgcacgggacgtggtggccaaaatgatcgtggtggagagttctcaggccttcacctggcaggcccagctccggcatcgctgggacgaagagaagcgacactgctttgccaacatctgcgatgcccaaatccagtattcctatgagtatctgggcaacacgccgcggctggtcatcaccccactcactgacaggtgctatatcaccctgacccagtccctccatctcatcatgggtggagcccctgccggccccgctgggaccggcaagactgagacgaccaaggacctgggcagagccctgggcaccatggtctacgtcttcaactgctccgagcagatggactacaagtcctgtggaaatatctacaagggcctggcccagacgggagcctggggctgctttgacgagtttaatcgcatctcagtggaagtcttgtctgtgattgccgtgcaggtaaaatgtgtccaggatgcaattcgggccaagaaaaaagcattcaatttcctgggagagatcataggcctcattcccaccgtcggtatcttcatcaccatgaaccctgggtacgccggacgcgcggagctgcctgagaacctaaaagccttattcaggccctgtgccatggtcgtccccgacttcgaactgatatgtgagatcatgctcatggccgagggctttctggaagcccgccttctggccaggaagttcatcaccctgtacaccttgtgcaaggagctgctctcgaagcaggatcattacgactggggcctgagagccatcaagtctgtgctggtggtggccggctccctgaagaggggcgaccccagccgggcagaggaccaggtgctcatgcgggcgctgagagacttcaacatccccaagattgtgacagacgacctgcccgtattcatgggactgatcggggacctcttcccggctctggacgtgcctcggaaacgggacctgaattttgaaaagatcatcaagcagagcatcgtggagctcaagctgcaggcggaggacagcttcgtgctgaaggtggtgcagctggaggagctgctgcaggtccgccactccgtgttcatcgtcgggaatgcgggcagcggcaaatctcaggtcctcaaatccctcaacaagacctatcagaacctgaagaggaagccggtcgccgtggacctggaccccaaggccgtcacctgcgacgagctctttggcatcatcaacccagtgaccagggaatggaaagatggcctgttctccaccatcatgcgagacctggccaacatcacccatgacggccccaagtggatcatccttgacggagacatagaccccatgtggatcgagtctctcaacacagtcatggatgacaacaaggtcctcaccctggccagcaacgagcggatccccctgaaccgcaccatgaggctggtgttcgaaatcagccacctgaggacggccaccccagccaccgtttccagagccggcatcctctacatcaacccagccgacctgggatggaacccggtggtgagcagctggatcgagaggcgcaaggtgcagtcggagaaggccaacctgatgatcctctttgacaagtacctgcccacgtgcctggacaagttgcgctttgggttcaagaagatcacgccagtgccggagatcacggtgatccaaacgattctgtacctgctggagtgcctgctcacggagaagaccgtgccccccgactcccccagggagctgtacgagctgtacttcgtgttcacctgcttctgggccttcggtggcgccatgttccaggaccagcttgtggattatcgagtggagttcagtaaatggtggatcaacgaattcaagactatcaagttcccctcgcagggaacgatttttgactactacattgatcctgacacaaaaaagttcctgccctggacagataaagtgccctcctttgagctggatcccgatgtcccactgcaggcctctttggtccacaccacggaaaccatccgcatccgctacttcatggacctgctcatggagaagtcctggccggtgatgctggtggggaacgcggggacgggcaagtcggtgctgatgggggacaagctggaaagcctgaacacggacaactacctggtgcaggctgtgcccttcaacttctacacgacctcagccatgctgcagggggtgctggagaagccgctggagaagaaatcggggaggaactacgggccgccaggcactaagaagctcgtctacttcatcgacgacatgaacatgcccgaggtggacaagtatgggacggtggccccgcacaccctcatccggcagcacatggaccaccggcactggtatgacagacataagctgacgttaaaagatatccataattgtcagtacgtggcctgcatgaaccccacttccggatccttcaccatcgactccaggcttcagcgccatttctgcgtgtttgctgtgagcttccccggccaggaggccctcaccaccatctacaacacaatcctgacgcagcacctggccttccgctcggtctccatggctatccagaggataagcagccagctggtggccgcggccctggctttgcatcagaaaatcacggcaacatttcttcccacggccattaagtttcattatgtcttcaacctcagggacctctccaatattttccagggactcttattttccacagcagaagttctgaaaaccccactggacctcgtccgcctttggctacatgagactgaacgagtgtatggtgacaaaatggttgacgaaaaagaccaggaaacattgcatagagtcaccatggcctccaccaagaagttctttgatgatcttggtgatgaactcttatttgccaagccaaatatcttctgccactttgctcaagggattggcgatcccaaatatgttcctgtaaccgacatggctcctctgaacaagctcctcgtggacgtcctggacagctacaatgaagttaatgcagtcatgaatttggtgctgtttgaggacgccgtggctcacatctgcaggattaatcgcatcctggagtctccccgggggaatgccctgctggtgggggtgggcggcagtggcaaacagagcctctcccgcctggcagcgtacatcagcgggcttgacgtgtttcagatcaccctcaagaagggctacgggatccccgacctcaagattgacctcgctgctcagtacataaaggctgccgtgaagaacgttccctcggtgttcctgatgacagactcccaggtggccgaggagcagtttctggtgctgatcaatgacctgctggcctcaggagagatccctgggctgtttatggaggacgaggtggagaacatcatctcctccatgcgaccccaagtcaagtcccttggcatgaatgacactcgggaaacatgttggaagttcttcatcgaaaaagtgcgcagacagctcaaggtgatcctgtgtttctcccctgtgggctccgtgctgcgggtacgagccagaaagttcccagctgtggtcaactgcacggccatcgactggttccacgagtggccggaagatgcgctggtgtccgtcagcgcccgcttcctggaggagactgaggggattccgtgggaagtcaaggcctccatcagcttcttcatgtcctacgtgcacaccaccgtcaacgagatgtccagggtatacctggctactgagaggcgctacaactacaccacacccaaaacctttctggagcagatcaaactgtaccagaacctgctggccaagaagagaacggaacttgttgccaaaatcgagaggctggagaacggcctgatgaagctgcagagcacggcttcccaggtggatgatttgaaagccaagttggcgattcaggaggctgagctcaagcagaagaatgagagcgcagaccaactgatccaggtggtcggcatcgaggccgagaaggtcagcaaagagaaggccattgctgaccaggaagaagtcaaggtcgaggtcatcaataagaacgtcactgagaagcaaaaggcctgtgaaacagacctggccaaagcagaaccggccctgctggcagcccaggaggctctggacactctgaataagaacaacctgacagagctgaagtcctttgggtccccgccggatgctgtggtcaacgtcaccgccgccgtcatgattctgaccgcacctgggggcaagatccccaaggacaagagctggaaggcggccaagatcatgatgggcaaggtggacaccttcctagactccctgaagaagttcgacaaggagcacatccctgaggcctgcctgaaggccttcaagccctaccaaggcaacccgacgttcgaccccgagttcatccgctccaagtccacggccgccgccggcctgtgctcctggtgcatcaacatcgtccgcttctacgaggtctactgcgacgtggcgcccaagaggcaggcactggaggaggctaatgcagagctggcagaggcacaagagaagctgtcccggatcaaaaacaagattgccgaacttaacgccaacctgagcaacctaacctcagcgtttgaaaaagcaacagctgagaaaatcaagtgtcagcaagaggccgatgccacgaacagggtgatcttactggcgaacaggctggtcgggggattagcatcggaaaacatccgctgggctgagtctgtggagaacttcaggagccagggggtcacgctgtgtggggacgtcctgctcatctctgccttcgtgtcctacgtgggctacttcaccaagaaataccggaatgagctgatggagaaattctggatcccttacatacataacttaaaggtccccatcccgatcacgaatggcctggatcccttgagcctgctgacagatgacgcggacgtggccacctggaacaaccagggcctccccagcgaccgcatgtccaccgagaatgccaccatcctgggcaacaccgagcggtggccgctgatcgtggacgcccagctccaaggaatcaagtggatcaaaaacaaatacaggagtgaactgaaagccatccgcctgggacagaagagctacctggatgtcatcgagcaggccatctcggaaggggacaccttgctcattgagaacatcggcgaaaccgtggaccccgtgctggaccctctactgggcaggaacacgattaaaaagggaaagtacattaagatcggtgacaaggaggtggagtaccaccccaagttccgcctgatcctacacaccaagtacttcaacccacactacaagccagagatgcaggctcagtgcaccctcatcaacttcctggtcaccagggatggactcgaggaccaactcttggccgctgtggtggccaaagagcgcccagatctggaacagctgaaggcaaacctcaccaagtctcaaaacgaatttaagattgttctgaaagagctggaagattcgctcctggcccgtctgtcggctgcgtcggggaactttctgggagacacggccttggtggagaatctggagaccaccaagcacacagccagcgagatcgaggagaaggtggtggaggcaaaaatcacagaagttaaaatcaacgaagcgagagagaactaccgcccggctgcggagagggcatctctgctctacttcatactgaacgatctcaacaaaatcaaccccgtctaccagttctccctcaaggccttcaacgtggtgtttgagaaagccatccagaggaccacccctgccaacgaggtgaagcagcgggtgatcaacctgacggacgagatcacctactccgtctacatgtacacggcccggggactcttcgagagggacaaactcattttcctggcacaagttacgtttcaggtcctgtccatgaagaaggagctgaacccagtggagctggatttcctcctgcggttcccttttaaggccggagtggtctcaccagtggacttcctccagcatcaaggctggggcgggatcaaggccctctcggagatggatgagttcaaaaatctggacagtgacatcgaaggatctgccaagcgctggaaaaagctggtggagtcggaagcccccgagaaggagatcttccccaaggagtggaagaacaagacggccctgcagaagctgtgcatggtgcgctgcctgcggccagatcgcatgacctacgctatcaagaacttcgtggaggaaaagatgggcagcaagttcgtggaaggccggagtgttgagttttctaagtcctacgaggagagcagcccctccacgtcaatcttcttcatcctctccccgggggttgaccccttgaaagacgtggaagccctgggaaaaaaactagggtttaccatagacaatggaaaactccataatgtgtccctggggcagggacaagaggtggtggctgagaacgccctggacgtggctgcagagaaaggacactgggtcattctgcagaatatccacctggtggcccggtggctgggaacactggacaagaagctggagcactacagcacgggcagccatgaggactaccgggtgttcatcagcgcggagcctgcccccagccccgagacccacatcatcccccagggcattctggagaacgccatcaagatcaccaacgagccccccacgggcatgcacgccaacttgcacaaggccctggacctgttcacccaggacaccctggagatgtgcaccaaggagatggagttcaagtgcatgctcttcgccctgtgctacttccacgctgtggtggcagagaggcgcaagttcggcgcccagggctggaaccggtcgtaccccttcaacaacggggacctcaccatctccatcaacgtgctctacaactacctggaggccaaccccaaggtgccctgggacgatctccgctacctttttggtgaaatcatgtatggcggccacatcacagatgactgggaccgtcggctgtgcaggacctacctggctgaatacatccggacggagatgctggagggagacgtcctgctggcccccggctttcagatcccccccaacctggactacaagggttaccacgaatacatcgatgagaacctgccccctgagagtccctatctgtatggcctgcaccccaacgcagagattggctttctgacggtcacctcagagaagctgttccgcactgtcctggaaatgcagccaaaagagacggactcgggggcaggcacgggagtgtcccgcgaggagaaggtgaaggccgtgctggacgacatcctggagaagattccggagactttcaacatggctgagatcatggcaaaggcagcggaaaagaccccctacgtggtagtcgcctttcaagaatgtgaaagaatgaacatcctgaccaacgaaatgcgccgttcgctcaaggagctgaacctggggctgaagggagaactgaccatcacgaccgacgtggaagatctgtccacggctctcttctatgacaccgtgcctgatacgtgggtggcccgggcctacccctccatgatgggcctggcggcctggtacgcagacctgctgctccgcatcagggaactcgaggcctggacgacagactttgccctgcccaccaccgtgtggctggccggcttcttcaacccccagtcgttcctcacggccatcatgcagtccatggccaggaagaacgagtggcccctggacaagatgtgtctgtctgtcgaggtgaccaagaaaaaccgagaggacatgaccgctcctccgcgagagggctcctacgtgtacggactcttcatggaaggggctcgctgggacacccagactggagtcatcgctgaagcgcggctgaaagagctgaccccggccatgcctgtcatcttcatcaaggccattcctgtggaccgcatggagaccaagaacatctatgagtgtcccgtgtacaaaacacgcatccgcggccccacctatgtctggacctttaacttgaagaccaaagagaaggcagcgaagtggatcctggcagccgtggcgctgctcctacaggtttagctcgctcctgcctcacagcccacactccctggggctggaccacaactcagcccttcacctgtgcacctgtgacttattctttacaggaactggtggtggtttttcgttctcttaaataatcaggtgctttgtaaccaagcacatcggaaccagagggtggaggttggtgtggaagaggtggggcagattaaagccagtggagccactca

SEQ ID NO: 128527 - DNA, 5220 bp, Homo sapiens
  Payload ID: 5155
  Gene Symbol: DNAH17
  Gene Name: dynein, axonemal, heavy chain 17
  ENST ID: ENST00000591369
  CDS Start-End: 1-4691
gagaagggagaacggagggggaggggaaaccagggccagcgagggctgtgcctgccgagacagcgtgcgtgacctcggggactcggctggggtccaggatccgaaaccttcagattgacctcgctgctcagtacataaaggctgccgtgaagaacgttccctcggtgttcctgatgacagactcccaggtggccgaggagcagtttctggtgctgatcaatgacctgctggcctcaggagagatccctgggctgtttatggaggacgaggtggagaacatcatctcctccatgcgaccccaagtcaagtcccttggcatgaatgacactcgggaaacatgttggaagttcttcatcgaaaaagtgcgcagacagctcaaggtgatcctgtgtttctcccctgtgggctccgtgctgcgggtacgagccagaaagttcccagctgtggtcaactgcacggccatcgactggttccacgagtggccggaagatgcgctggtgtccgtcagcgcccgcttcctggaggagactgaggggattccgtgggaagtcaaggcctccatcagcttcttcatgtcctacgtgcacaccaccgtcaacgagatgtccagggtatacctggctactgagaggcgctacaactacaccacacccaaaacctttctggagcagatcaaactgtaccagaacctgctggccaagaagagaacggaacttgttgccaaaatcgagaggctggagaacggcctgatgaagctgcagagcacggcttcccaggtggatgatttgaaagccaagttggcgattcaggaggctgagctcaagcagaagaatgagagcgcagaccaactgatccaggtggtcggcatcgaggccgagaaggtcagcaaagagaaggccattgctgaccaggaagaagtcaaggtcgaggtcatcaataagaacgtcactgagaagcaaaaggcctgtgaaacagacctggccaaagcagaaccggccctgctggcagcccaggaggctctggacactctgaataagaacaacctgacagagctgaagtcctttgggtccccgccggatgctgtggtcaacgtcaccgccgccgtcatgattctgaccgcacctgggggcaagatccccaaggacaagagctggaaggcggccaagatcatgatgggcaaggtggacaccttcctagactccctgaagaagttcgacaaggagcacatccctgaggcctgcctgaaggccttcaagccctaccaaggcaacccgacgttcgaccccgagttcatccgctccaagtccacggccgccgccggcctgtgctcctggtgcatcaacatcgtccgcttctacgaggtctactgcgacgtggcgcccaagaggcaggcactggaggaggctaatgcagagctggcagaggcacaagagaagctgtcccggatcaaaaacaagattgccgaacttaacgccaacctgagcaacctaacctcagcgtttgaaaaagcaacagctgagaaaatcaagtgtcagcaagaggccgatgccacgaacagggtgatcttactggcgaacaggctggtcgggggattagcatcggaaaacatccgctgggctgagtctgtggagaacttcaggagccagggggtcacgctgtgtggggacgtcctgctcatctctgccttcgtgtcctacgtgggctacttcaccaagaaataccggaatgagctgatggagaaattctggatcccttacatacataacttaaaggtccccatcccgatcacgaatggcctggatcccttgagcctgctgacagatgacgcggacgtggccacctggaacaaccagggcctccccagcgaccgcatgtccaccgagaatgccaccatcctgggcaacaccgagcggtggccgctgatcgtggacgcccagctccaaggaatcaagtggatcaaaaacaaatacaggagtgaactgaaagccatccgcctgggacagaagagctacctggatgtcatcgagcaggccatctcggaaggggacaccttgctcattgagaacatcggcgaaaccgtggaccccgtgctggaccctctactgggcaggaacacgattaaaaagggaaagtacattaagatcggtgacaaggaggtggagtaccaccccaagttccgcctgatcctacacaccaagtacttcaacccacactacaagccagagatgcaggctcagtgcaccctcatcaacttcctggtcaccagggatggactcgaggaccaactcttggccgctgtggtggccaaagagcgcccagatctggaacagctgaaggcaaacctcaccaagtctcaaaacgaatttaagattgttctgaaagagctggaagattcgctcctggcccgtctgtcggctgcgtcggggaactttctgggagacacggccttggtggagaatctggagaccaccaagcacacagccagcgagatcgaggagaaggtggtggaggcaaaaatcacagaagttaaaatcaacgaagcgagagagaactaccgcccggctgcggagagggcatctctgctctacttcatactgaacgatctcaacaaaatcaaccccgtctaccagttctccctcaaggccttcaacgtggtgtttgagaaagccatccagaggaccacccctgccaacgaggtgaagcagcgggtgatcaacctgacggacgagatcacctactccgtctacatgtacacggcccggggactcttcgagagggacaaactcattttcctggcacaagttacgtttcaggtcctgtccatgaagaaggagctgaacccagtggagctggatttcctcctgcggttcccttttaaggccggagtggtctcaccagtggacttcctccagcatcaaggctggggcgggatcaaggccctctcggagatggatgagttcaaaaatctggacagtgacatcgaaggatctgccaagcgctggaaaaagctggtggagtcggaagcccccgagaaggagatcttccccaaggagtggaagaacaagacggccctgcagaagctgtgcatggtgcgctgcctgcggccagatcgcatgacctacgctatcaagaacttcgtggaggaaaagatgggcagcaagttcgtggaaggccggagtgttgagttttctaagtcctacgaggagagcagcccctccacgtcaatcttcttcatcctctccccgggggttgaccccttgaaagacgtggaagccctgggaaaaaaactagggtttaccatagacaatggaaaactccataatgtgtccctggggcagggacaagaggtggtggctgagaacgccctggacgtggctgcagagaaaggacactgggtcattctgcagaatatccacctggtggcccggtggctgggaacactggacaagaagctggagcactacagcacgggcagccatgaggactaccgggtgttcatcagcgcggagcctgcccccagccccgagacccacatcatcccccagggcattctggagaacgccatcaagatcaccaacgagccccccacgggcatgcacgccaacttgcacaaggccctggacctgttcacccaggacaccctggagatgtgcaccaaggagatggagttcaagtgcatgctcttcgccctgtgctacttccacgctgtggtggcagagaggcgcaagttcggcgcccagggctggaaccggtcgtaccccttcaacaacggggacctcaccatctccatcaacgtgctctacaactacctggaggccaaccccaaggtgccctgggacgatctccgctacctttttggtgaaatcatgtatggcggccacatcacagatgactgggaccgtcggctgtgcaggacctacctggctgaatacatccggacggagatgctggagggagacgtcctgctggcccccggctttcagatcccccccaacctggactacaagggttaccacgaatacatcgatgagaacctgccccctgagagtccctatctgtatggcctgcaccccaacgcagagattggctttctgacggtcacctcagagaagctgttccgcactgtcctggaaatgcagccaaaagagacggactcgggggcaggcacgggagtgtcccgcgaggagaaggtgaaggccgtgctggacgacatcctggagaagattccggagactttcaacatggctgagatcatggcaaaggcagcggaaaagaccccctacgtggtagtcgcctttcaagaatgtgaaagaatgaacatcctgaccaacgaaatgcgccgttcgctcaaggagctgaacctggggctgaagggagaactgaccatcacgaccgacgtggaagatctgtccacggctctcttctatgacaccgtgcctgatacgtgggtggcccgggcctacccctccatgatgggcctggcggcctggtacgcagacctgctgctccgcatcaggcggctcgtgtgtccttgcaggaactcgaggcctggacgacagactttgccctgcccaccaccgtgtggctggccggcttcttcaacccccagtcgttcctcacggccatcatgcagtccatggccaggaagaacgagtggcccctggacaagatgtgtctgtctgtcgaggtgaccaagaaaaaccgagaggacatgaccgctcctccgcgagagggctcctacgtgtacggactcttcatggaaggggctcgctgggacacccagactggagtcatcgctgaagcgcggctgaaagagctgaccccggccatgcctgtcatcttcatcaaggccattcctgtggaccgcatggagaccaagaacatctatgagtgtcccgtgtacaaaacacgcatccgcggccccacctatgtctggacctttaacttgaagaccaaagagaaggcagcgaagtggatcctggcagccgtggcgctgctcctacaggtttagctcgctcctgcctcacagcccacactccctggggctggaccacaactcagcccttcacctgtgcacctgtgacttattctttacaggaactggtggtggtttttcgttctcttaaataatcaggtgctttgtaaccaagcacatcggaaccagagggtggaggttggtgtggaagaggtggggcagattaaagccagtggagccactca

SEQ ID NO: 128528 - DNA, 13505 bp, Homo sapiens
  Payload ID: 5156
  Gene Symbol: DNAH2
  Gene Name: dynein, axonemal, heavy chain 2
  Uniprot ID: Q9P225
  ENST ID: ENST00000389173
  CDS Start-End: 15-13298
gttttgcctgcacgatgtccagcaaagctgagaagaagcagcgattgagtggccgaggaagctcccaggcaagctggtcagggcgggccactcgggctgctgtggccacacaggagcaggggaatgccccggctgtcagtgagccagagctgcaggctgagctccccaaggaggagcctgagccacggttggagggacctcaagcacagagtgaagaatcagtggagcccgaggcagatgtgaagcccctcttcctttcccgagctgcgctgacaggactggcggatgcagtgtggacacaggagcatgatgccattctggaacactttgcccaggaccctacagaatccatcctcaccatcttcattgacccttgttttgggctgaagctagagctgggcatgcctgtacagacccagaaccagcttgtctacttcattcgccaagcaccagttcccatcacctgggagaacttcgaggcaactgtgcagtttgggacggtgcggggcccctatatcccggccctgcttcggctgctcggtggagtctttgcccctcagatctttgcaaacacaggctggcctgagagcattagaaatcattttgcttctcatctgcacaagttcttggcctgcctgacagacactcggtacaaactggaggggcacacggtcctctacatccctgcagaggccatgaacatgaagcctgagatggtgataaaggacaaagagctggtgcaacggctagagacctccatgatccactggacccggcagataaaggagatgctcagtgcccaggagactgtggagacaggagaaaatttaggtcctctggaggagattgagttctggcgcaaccgatgcatggacctgtctggcatcagtaagcagctggtgaagaagggagtgaagcacgttgaatccatcctgcaccttgccaagtcgtcctacttggcgccctttatgaaactggcacagcagatccaggatggctctcgtcaagcacagtcaaacctgacctttttgtcaatcctgaaggaaccttaccaggagttggctttcatgaagcccaaggacatctctagcaagctccctaagctgatcagtctcatccgcatcatctgggtcaactctccccactacaacactcgggagagactgacctcgctcttccgaaaggtatgtgactgtcagtatcacttcgcccgctgggaagatggcaagcagggtccccttccttgcttctttggtgcccaggggccacagataacacggaacttgctggagattgaggacatctttcataaaaatctgcacacgctgcgagccgttcgcgggggtatcctggatgtcaagaacacctgttggcatgaagactacaataagttccgtgccggaatcaaggacctggaggtgatgacccagaacctgatcacctcagccttcgagttggtgcgggacgtgccgcacggcgtgcttctgctggacaccttccacaggcttgcctcccgcgaggctatcaagcggacttatgacaagaaggcggtggatctctacatgctgttcaatagcgagctggccctggtgaaccgtgaacggaacaagaaatggccagacctggagccctacgtggcccagtattccggaaaggcgcgctgggtgcacatcctccggcgtcgcatcgacagagtcatgacctgccttgctggtgctcatttcctgccccgtattgggactggaaaggagagtgtgcacacctatcagcagatggtccaggccattgatgagctggttcgaaaaaccttccaagagtggacatcaagtctggacaaggattgcattcggcggttggataccccattgctgcgaatcagccaggagaaggcgggcatgctggatgtcaactttgacaagtcccttctgattctctttgcggaaattgactactgggagcggctgctgtttgagacgccccattacgtggtgaacgtagctgagcgagccgaggacctgcgcattctgcgtgaaaatctgctactcgttgctagagactacaataggattattgccatgctgtccccagatgagcaggccctattcaaagagcgtattcggctcctggataagaagatccacccgggactcaagaaactgcactgggccttgaagggggccagtgccttcttcatcacggagtgccgtatacatgccagcaaggtgcagatgattgtgaatgagttcaaggcatccactctgaccattggctggcgagcccaagagatgtcagagaagctgctggtacgcattagtggcaaacgggtatacagggacctggaatttgaagaggaccaaagagagcatcgggcagctgtacagcagaaattgatgaacctgcaccaggatgtggtgaccatcatgaccaactcctatgaggtcttcaagaatgatggtcctgagattcagcagcagtggatgctgtacatgattcggctggaccgcatgatggaggatgccctgcgcctgaatgtgaagtggtcactgctagaactatccaaggctatcaacggggatggaaagaccagcccaaacccactcttccaagtccttgtcattttgaagaatgatctgcaaggaagtgtggcacaggtggaattctcacccactctgcagactttggcaggtgtggtcaatgacattggcaaccacctcttttccaccatctctgtcttctgccacctccctgacattctcaccaagcgcaagttacatcgtgaacccatccaaacagttgtggagcaagatgaggacatcaagaagatccagacccaaatcagcagcggcatgactaacaacgcaagcctgctgcagaactacctcaagacctgggacatgtaccgggagatctgggagatcaacaaggactccttcattcatcgctaccagcgcctcaaccctcctgtctcttcttttgttgccgacattgcccgctacacggaagttgctaataacgtgcagaaggaggagacagtcaccaacatccagtttgtgctgctggactgttcgcacctcaagttctccctggtgcagcactgcaatgaatggcagaacaagttcgcgactctgctcagggagatggctgctgggcgcctcctggagctgcacacctacctgaaggagaacgcagagaaaatcagccgccctccgcagacactggaggaactgggggtcagcttgcagctcgtggatgccctgaagcacgacttggccaacgtggagactcagatccctcccatacacgagcaatttgccattcttgaaaagtacgaggtgccagtcgaggacagtgtcctggagatgctggacagtctcaacggggagtgggttgtcttccaacaaactctgctggacagtaagcaaatgctgaagaaacacaaggagaaattcaagacaggcctgatccactcggcagatgacttcaagaagaaagcacatacacttctggaagatttcgaattcaaaggccatttcaccagcaacgtgggatacatgtctgccttagaccagattacacaagtgcgggccatgctgatggccatgcgggaagaggaaaatagtctccgagccaacctgggcatcttcaagatcgagcagccaccctccaaggaccttcagaacctggagaaggagctcgatgccctccagcaaatctgggagatcgcacgagactgggaggagaactggaatgagtggaagactggccggttcctgatcctgcagacggaaaccatggagaccacggcccacgggctgtttcgtcgcctcacaaaattagccaaagagtataaggaccgaaactgggaaattattgaaaccactcgctcaaaaatagagcagttcaagaggaccatgcctctcatctcagacctgcggaaccctgcccttagagagaggcactgggaccaggtccgggatgagatccagcgggagtttgatcaggaatctgaaagcttcaccttggagcagattgtggagcttgggatggatcagcatgtggagaaaattggggagatctctgcttcagcaactaaagagctggctatagaagtggctttacaaaacattgccaagacctgggatgtgactcagctcgacatagtaccctacaaggataagggccatcatcggctcagaggtacagaagaagtattccaggcactggaagataaccaggtagctctgtctaccatgaaggcatcacgctttgtcaaggcctttgagaaggatgtggaccactgggaacgctgcctctccctcattttggaggttattgagatgattctcacagtgcagcgtcagtggatgtacttagagaatatcttcctaggagaagacatccgcaagcagctgcccaatgaatcgaccttatttgaccaggtcaacagcaactggaaagccatcatggacaggatgaacaaggacaacaatgctctccggagcacccatcacccaggcctcctggacacattgatagaaatgaatacaatcctggaagatattcagaaatctctggatatgtatttagagaccaagcgacatattttcccccgcttctacttcttgtccaatgatgacctgctggagattctgggccagtcccgaaacccagaggctgtgcagccacacctcaaaaaatgctttgacaacatcaagttgctgagaatccagaaggttggagggcccagcagcaaatgggaagctgtggggatgttctcgggcgacggcgagtacattgacttcctccactcagtatttttagaaggccctgtggagtcctggcttggcgatgtggaacagaccatgagggtgaccctgcgggaccttctccggaactgccacctggccctcaggaagttcctcaacaagagggacaaatgggtgaaggagtgggctggccaggtggtgatcactgccagtcagatccagtggacggctgatgtcaccaagtgcctgctgacagcgaaggagcgggcagacaagaaaatcctcaaggtcatgaagaagaaccaggtgtcaatcctgaataagtattcagaagccatcagggggaacttgaccaagatcatgcggcttaaaattgtggctctggtgacgatagaaattcatgcccgggatgtgttggagaagctttacaagagtggcctcatggatgtcaattcctttgactggctcagccaacttcggttctactgggagaaggatcttgatgactgtgtcatccgccagaccaacacgcaatttcagtataattatgagtacttgggtaactcgggccggctcgtcatcacccccctgacggacaggtgttacatgacactgaccacggcattgcacctgcaccgagggggctcccccaaaggccctgcaggcacaggcaagaccgagaccgtcaaggacctgggcaaggccctgggcatatatgtcattgtggtcaactgctctgagggcctggactacaagtccatgggccgaatgtactcaggtctggcccagactggagcttggggctgctttgatgagtttaaccgcatcaacatcgaggtgctgtcagtggtggcccaccagatcctgtgcatcctgtctgccctggctgccggcctcacccatttccattttgatggctttgaaataaatctggtgtggtcctgtgggatcttcattaccatgaatcctggctatgctggccgcacagagcttcccgaaaatcttaaatccatgttccgcccaattgccatggtggtgcctgactccaccctcattgcagaaatcattctctttggagagggctttggcaactgcaagattctggccaagaaggtgtacacactctactcactggctgtgcagcagctgtccagacaggaccactatgactttggcctgcgtgccctcacctcccttctgcgctatgctggcaagaagcgccgcctacagccggatctgactgatgaagaggttctgctgctctcaatgagagatatgaacatcgccaagctcacttcagttgatgcacccctgttcaatgccatcgtgcaagatctgtttcccaacattgagctgcctgtcattgactatggcaagctgcgggagaccgttgagcaggagattcgagacatgggcctgcaaagcacgccgttcaccctcaccaaggttttccagttgtatgaaaccaagaactcccgccactccaccatgatcgtgggctgcacgggcagcggcaagactgcctcatggcgcattctacaggcctccctgtcctctctgtgccgcgccggagaccctaacttcaacattgttagagagttccctttgaaccccaaggcattgtccctaggggaactgtatggggaatatgacctcagcaccaatgaatggacagatggcatcttgtccagtgtcatgcggacggcatgtgcagatgagaaacccgacgagaagtggatcctgttcgatggccccgtggacacactgtggatcgagaacatgaactccgtcatggacgataacaaggtgttgaccctcatcaacggcgagcgcatcgcgatgcccgagcaggtgtctctcctgtttgaagtggaggacctggcaatggcctctccggccactgtatcccgctgcgggatggtctacactgactacgctgacctgggctggaagccctatgttcagtcatggctggagaagaggccaaaggctgaggtggagccccttcaacgcatgttcgaaaagctcatcaacaagatgctggcctttaagaaggacaactgcaaggagctggtgcccctgcccgagtacagcggtatcacctccctctgcaagctgtactctgccctggccacgccagagaatggggtgaacccagctgacggcgagaactatgtcaccatggtagagatgacatttgtgttcagcatgatctggtctgtgtgtgcctctgtggatgaggagggccggaagaggatcgacagctacctccgagagatcgagggctcctttcccaataaggacacggtatatgagtattttgtggaccccaaaatacggagttggacatcatttgaggacaagctccctaagagttggcgctaccctccaaacgcccccttctataagatcatggtgcccaccgtcgacactgttcgctacaactacctggtgagcagcttggtggccaaccagaatcccattctgctggtgggtcccgtggggactgggaagacctccatcgcccagagcgttctgcagtccctgccctccagccagtggtcggtgctcgttgtcaacatgtccgcacagaccacatccaataacgtgcagagcatcattgagagcagggttgagaagcgaaccaagggtgtctacgtgccattcgggggcaaaagcatgatcacctttatggatgacctaaatatgcccgctaaggacatgtttgggtcccagccacccctggagctgatccgcctctggattgactatggcttctggtatgaccgtacgaagcagaccatcaagtacattcgagaaatgttcctgatggctgccatgggcccccctgggggtggacggactgtcatctccccaaggctacggagtcgcttcaacattatcaacatgaccttccccacaaagtcccagatcatccgcatattcggcaccatgatcaatcagaagcttcaggactttgaggaagaggtgaagcccattgggaacgtggtgacagaggccaccctggacatgtacaacaccgtggtacagcgcttcctgcccacgcccaccaagatgcattacctcttcaaccttcgagacatctccaaggtgttccagggcatgcttagagccaacaaggacttccatgataccaagtccagcatcacacggctctggatccatgaatgtttcagagtcttctctgaccggctggttgatgcggcagacacagaagccttcatgggcatcataagcgacaagctcggctccttctttgacctcacatttcatcatctctgtcccagcaagcgtcctcctatctttggggatttcctgaaggagcccaaggtgtatgaagacctcacggatctgacagtgctgaagacagtcatggagacagctctaaatgagtataacctgtcaccctctgtcgtgcccatgcagctagtgctcttccgagaggctattgaacacatcacacggatcgtgcgggtcattggacagcctcggggcaacatgctcctggtgggtatcgggggcagcggacgccagagtctggcccgcctggcttcatccatctgcgactacaccaccttccagatcgaggtcaccaaacattatcggaagcaggagttccgagatgatatcaagcgtctgtatcgccaggctggggtggagctcaagaccacgtccttcatttttgtggacacccaaatagctgatgagtccttcctagaggacatcaacaacatcctcagctcaggcgaggtgcccaatctctacaagcctgatgaatttgaagagatccagtcgcatatcatagaccaggcccgggtggagcaggtgcctgagtcatcggacagcctcttcgcctacctcattgaacgcgtgcagaacaacctgcacatcgtgctctgcctcagccccatgggggatcccttcaggaactggatccgccagtacccagccttggtgaactgcacaaccatcaactggttctcagagtggccccaagaggccctgctcgaggtggctgagaagtgcctcataggagtagacctgggaactcaggagaatatccacaggaaggtggcccagatctttgtcactatgcactggtcagtagctcagtattcccagaagatgctgttggaactgcggagacacaactatgtcacacccaccaaatacctggaactcctgtctggatataagaagttgctgggagaaaaacggcaggagctgctggcccaagccaataaactgcggacaggcttgttcaagatcgacgaaactagggaaaaggtgcaagtgatgtcgttggagctggaggatgccaagaagaaggtggctgagttccagaagcagtgtgaggagtacctggtcatcattgtgcagcagaagcgggaggcagatgagcagcagaaggccgtaacagccaacagtgaaaagattgcagttgaggaaatcaagtgtcaggcactggctgacaatgcccagaaagatctagaagaggcactgcccgccctggaagaggccatgcgggccctggagtctctgaacaagaaggatataggagagatcaagtcttatggacggcccccagcccaagtggagatagtgatgcaggcagttatgattcttcgaggcaacgagcccacatgggcagaggccaagaggcagctaggggaacagaacttcatcaagtcactgatcaactttgataaagacaatatctcagataaggttctgaagaagattggggcctactgcgcccagcctgacttccagcctgatatcatcggccgcgtctccctggctgccaagtccctctgcatgtgggtgcgggccatggagctgtatgggcggctatatcgggtggtggagcccaagcgaatccgaatgaacgctgccttggctcagcttcgggagaagcaagccgcgctcgctgaggcccaggagaagctgcgggaggtagctgagaaactggagatgctaaagaaacagtatgatgagaagctggcacagaaggaggagcttcgcaagaagtctgaagagatggagctgaagctggagcgagctgggatgctcgtgtcggggttggctggcgagaaggccagatgggaggagacagtccagggcctggaggaggacctgggctacctggtgggggactgtctcctggcagctgccttcctgtcctacatgggacccttcctgaccaactaccgggatgagattgtcaaccaaatctggatcgggaagatctgggagcttcaggttccttgctccccttctttcgccatcgataacttcctgtgcaatcctaccaaagtccgggactggaacatccaagggttgccctcagacgccttctccactgagaatggcatcatcgtcacccgaggcaacaggtgggcactgatgatcgaccctcaggcccaggccctgaaatggattaagaacatggaaggaggccagggcctgaagatcatcgacctgcagatgagcgattacctgcgaatcctagaacacgccattcactttggatacccggtgctacttcagaacgtgcaggaatatctggaccccacactgaaccccatgctcaacaaatctgtagcccgaatcggtggtcggctgttgatgcgcattggcgataaggaggtggaatataataccaatttccgtttctacatcaccaccaagctctccaacccccactacagcccagagacctcagccaagaccaccatcgtcaactttgctgttaaagaacagggcctggaggcccagctgctgggcattgtggtgcggaaggagcggcctgagctggaggagcagaaggactcactggtcatcaacatcgcggctggtaaaaggaagctcaaggagctggaggatgagatcctgcggctgctgaatgaggccaccggctccctgctggatgatgtgcagctggtgaacacgctgcatacctccaagatcacagccacagaggtgactgagcagctggagaccagtgagaccacagagatcaacactgacttggcgcgggaggcttaccgcccatgcgcccagcgggcatcaatcctgttcttcgtgctcaatgatatgggctgcatcgaccccatgtaccagttctcactggatgcctacatcagcctctttattctcagcattgacaaaagccaccgcagcaataagctggaggaccgcattgactacctgaatgactaccacacctacgctgtctacaggtacacctgccgtacccttttcgaacgccacaaactactattcagttttcatatgtgtgccaaaatcttggagacttctggcaagctcaacatggatgaatacaacttctttctacgtgggggtgtggtcttggatcgggagggccaaatggacaatccatgtagtagctggcttgcagatgcctactgggataacatcacagagctagacaaactgaccaacttccacggactcatgaactcctttgagcagtaccctcgtgactggcacctgtggtataccaatgctgccccggagaaggcgatgctgccaggtgagtgggaaaatgcctgcaatgaaatgcaacggatgctgatcgttcgctccctgcgccaggaccgcgtggccttctgcgtgacctccttcatcatcaccaaccttggctcccgcttcatcgagccgcctgtgctgaatatgaagtcggtgctggaggattcaaccccacgatccccactcgtgttcatcctgtcccctggtgtggaccccaccagtgccctgctgcagctggcagagcacatgggcatggcccagcgcttccacgccctgtccctgggccagggccaggcccccatcgctgctcggctcctccgagagggtgtgactcagggacactgggtgttcctggcaaactgccacctgtcactgtcttggatgcctaatctggacaagctggtggagcagctgcaggtggaggatcctcatccatccttccgcctctggctcagctccatcccccacccagacttccctatctcaatcttgcaggtcagcatcaagatgaccacagagccaccaaagggcctaaaggccaacatgacacgtctttaccaactgatgtcagaaccacagttttcccgctgctccaaacctgccaaatataagaagctgctgttttcactctgtttcttccactctgtgttacttgaacgcaaaaagttcctgcagcttggctggaacatcatctatggcttcaatgactccgactttgaggtgtcagaaaacttgctgagcctctatctcgatgagtacgaggagacaccttgggacgcacttaagtacctcattgccggcatcaactatggtggacatgtcacagatgactgggaccggcgcctgctgaccacctacatcaatgattatttctgtgaccagtctctatcaactcccttccaccggttgtcagcactggagacttatttcatccccaaggatggcagcctcgcttcttacaaggaatacatcagcttattgcctggcatggacccccctgaggcctttggccagcaccccaatgctgatgtggcctctcagatcactgaggcacaaaccctctttgatactttgctttccttgcaacctcagattacacccaccagggctggaggccagacccgggaagagaaggtccttgagttggccgctgatgtgaagcagaagatccctgaaatgatcgactatgaggggactcaaaaactgctagctctcgacccctcccccctcaatgtggtccttctgcaggagatccagagatacaacacactgatgcagaccatcctgttctcactgacagacctagagaaaggcatccagggtctcatcgtcatgtctacaagcctggaagagattttcaattgcatctttgatgcccatgttcctccgctctggggaaaggcatacccctcacaaaagccattggctgcctggacccgggacttggccatgcgtgtggagcagtttgagctgtgggccagccgggcccggcctcctgtgatcttctggttgtctggtttcacctttcccactggcttcctcactgctgtgctgcagtcttcagctcgccaaaacaacgtttcagtggacagcctctcctgggagtttatcgtttccactgtggatgacagcaacctagtgtatccccccaaggatggtgtctgggtccggggcctgtacctggaaggtgctggctgggaccggaagaactcctgcttggtggaggcagagcccatgcagcttgtctgcctcatgcccacgatccacttccggcctgcagagagccgcaagaagagcgccaagggcatgtactcctgcccctgctattactatcccaaccgggcaggcagctcagaccgagcctcctttgtcatcggcattgacctgcggtctggggccatgacacctgatcattggatcaagaggggcactgctctactcatgagcctggacagctgagacctcctcctcttctccgcttgagagagagggtcagggactccaggagctaagacagatgttgcacctaggactgaggccggacctcactcagactttgaccttggccgaatttgtgtgatgtggccctggagatacctagttgtgttagccataaaagtgaaagagttgtattggagctcagtgctgtaaaacacccgcgacaac

SEQ ID NO: 128529 - DNA, 14955 bp, Homo sapiens
  Payload ID: 5156
  Gene Symbol: DNAH2
  Gene Name: dynein, axonemal, heavy chain 2
  Uniprot ID: Q9P225
  ENST ID: ENST00000572933
  CDS Start-End: 1461-14744
cttctacatcgcgaatatccctcgccggcctggcgcccggcgccatctgctggacccgttccggctggggcgcacagacctgggcgcggggtcgggcgattgggttctccctgccttttcaatgtcctgcggggcggtggctcactgtctctcgccccagcccttccagctgggtcctgacaccaggccccccgcacccttcggctcgccagatgtggctactttcctttagtcccggagccttcaagccctgggtccctgaggggtagacctgggcggggtggggccgcgaagcagggatccagggcgcctgcgcggaggaggcgggctccgaggggccgcacaccggccactcgcccctccctgcccggggttgccatggggacgcgtgcagacgccggcccgagagggctgcgaggggcaacttcttagagtggcccatcggtcggtctagggaggggagggtcagcgtggcaaggtgtgtgtcgggggcagagggaaggagggaaggagtgctggggagaaggggcagtagtgtcggggtaggaagggacagttgttggggagaagaggcagttgtggagggagagggagcaaggaatatttgtgtgggggagggggaggagaaggggcagttgtgacagctgggggggaagagccattctgaggggaaatttgcctgctggtaaccagtttaaggataccagctgctggtataaatactgctggataaatactgctggatttatactgcaggataaatactgctggcccctgcggtatttcctagtactagagtgagccccgacttagcagagcagttcctcctggggcctgcggtgtgggatcgcgtggtgaaccccacggtgcatgcgcctcaggctctagtttgaggcaggaaagcgcagcttgatgcttctctggagactgatggaggaagcctccttgctgtagttggttttattgatttgctggcctaacagaacgtttttccttggagcaaagtacaaatccttcaagtttgaaattcataacctgagatcaatgcctgtggcagcctgtggggatgaggaaggagagccacaggtgccgttaggctgcagcctaatgaaaagagagtgcccagcgcctcagactttgcgcctgggattctgagcacctgtccgagatccccgcttcctgccatcctacctttctgagagaggcaccactgtgaccttcctcgtgccccaattgctttttcctcatgacacaatttgaaatttatgattggatgacttttgtccttctttcttccaatctgttctcagggcattttgagtcaaataaatgatcctgactgatcttaaccattagcacagagttcctcagccaactctgctaagagacctcagtacacacaaaacagtgttcctgcccctcaggacttcaaagcgatagacccaggttttgcctgcacgatgtccagcaaagctgagaagaagcagcgattgagtggccgaggaagctcccaggcaagctggtcagggcgggccactcgggctgctgtggccacacaggagcaggggaatgccccggctgtcagtgagccagagctgcaggctgagctccccaaggaggagcctgagccacggttggagggacctcaagcacagagtgaagaatcagtggagcccgaggcagatgtgaagcccctcttcctttcccgagctgcgctgacaggactggcggatgcagtgtggacacaggagcatgatgccattctggaacactttgcccaggaccctacagaatccatcctcaccatcttcattgacccttgttttgggctgaagctagagctgggcatgcctgtacagacccagaaccagcttgtctacttcattcgccaagcaccagttcccatcacctgggagaacttcgaggcaactgtgcagtttgggacggtgcggggcccctatatcccggccctgcttcggctgctcggtggagtctttgcccctcagatctttgcaaacacaggctggcctgagagcattagaaatcattttgcttctcatctgcacaagttcttggcctgcctgacagacactcggtacaaactggaggggcacacggtcctctacatccctgcagaggccatgaacatgaagcctgagatggtgataaaggacaaagagctggtgcaacggctagagacctccatgatccactggacccggcagataaaggagatgctcagtgcccaggagactgtggagacaggagaaaatttaggtcctctggaggagattgagttctggcgcaaccgatgcatggacctgtctggcatcagtaagcagctggtgaagaagggagtgaagcacgttgaatccatcctgcaccttgccaagtcgtcctacttggcgccctttatgaaactggcacagcagatccaggatggctctcgtcaagcacagtcaaacctgacctttttgtcaatcctgaaggaaccttaccaggagttggctttcatgaagcccaaggacatctctagcaagctccctaagctgatcagtctcatccgcatcatctgggtcaactctccccactacaacactcgggagagactgacctcgctcttccgaaaggtatgtgactgtcagtatcacttcgcccgctgggaagatggcaagcagggtccccttccttgcttctttggtgcccaggggccacagataacacggaacttgctggagattgaggacatctttcataaaaatctgcacacgctgcgagccgttcgcgggggtatcctggatgtcaagaacacctgttggcatgaagactacaataagttccgtgccggaatcaaggacctggaggtgatgacccagaacctgatcacctcagccttcgagttggtgcgggacgtgccgcacggcgtgcttctgctggacaccttccacaggcttgcctcccgcgaggctatcaagcggacttatgacaagaaggcggtggatctctacatgctgttcaatagcgagctggccctggtgaaccgtgaacggaacaagaaatggccagacctggagccctacgtggcccagtattccggaaaggcgcgctgggtgcacatcctccggcgtcgcatcgacagagtcatgacctgccttgctggtgctcatttcctgccccgtattgggactggaaaggagagtgtgcacacctatcagcagatggtccaggccattgatgagctggttcgaaaaaccttccaagagtggacatcaagtctggacaaggattgcattcggcggttggataccccattgctgcgaatcagccaggagaaggcgggcatgctggatgtcaactttgacaagtcccttctgattctctttgcggaaattgactactgggagcggctgctgtttgagacgccccattacgtggtgaacgtagctgagcgagccgaggacctgcgcattctgcgtgaaaatctgctactcgttgctagagactacaataggattattgccatgctgtccccagatgagcaggccctattcaaagagcgtattcggctcctggataagaagatccacccgggactcaagaaactgcactgggccttgaagggggccagtgccttcttcatcacggagtgccgtatacatgccagcaaggtgcagatgattgtgaatgagttcaaggcatccactctgaccattggctggcgagcccaagagatgtcagagaagctgctggtacgcattagtggcaaacgggtatacagggacctggaatttgaagaggaccaaagagagcatcgggcagctgtacagcagaaattgatgaacctgcaccaggatgtggtgaccatcatgaccaactcctatgaggtcttcaagaatgatggtcctgagattcagcagcagtggatgctgtacatgattcggctggaccgcatgatggaggatgccctgcgcctgaatgtgaagtggtcactgctagaactatccaaggctatcaacggggatggaaagaccagcccaaacccactcttccaagtccttgtcattttgaagaatgatctgcaaggaagtgtggcacaggtggaattctcacccactctgcagactttggcaggtgtggtcaatgacattggcaaccacctcttttccaccatctctgtcttctgccacctccctgacattctcaccaagcgcaagttacatcgtgaacccatccaaacagttgtggagcaagatgaggacatcaagaagatccagacccaaatcagcagcggcatgactaacaacgcaagcctgctgcagaactacctcaagacctgggacatgtaccgggagatctgggagatcaacaaggactccttcattcatcgctaccagcgcctcaaccctcctgtctcttcttttgttgccgacattgcccgctacacggaagttgctaataacgtgcagaaggaggagacagtcaccaacatccagtttgtgctgctggactgttcgcacctcaagttctccctggtgcagcactgcaatgaatggcagaacaagttcgcgactctgctcagggagatggctgctgggcgcctcctggagctgcacacctacctgaaggagaacgcagagaaaatcagccgccctccgcagacactggaggaactgggggtcagcttgcagctcgtggatgccctgaagcacgacttggccaacgtggagactcagatccctcccatacacgagcaatttgccattcttgaaaagtacgaggtgccagtcgaggacagtgtcctggagatgctggacagtctcaacggggagtgggttgtcttccaacaaactctgctggacagtaagcaaatgctgaagaaacacaaggagaaattcaagacaggcctgatccactcggcagatgacttcaagaagaaagcacatacacttctggaagatttcgaattcaaaggccatttcaccagcaacgtgggatacatgtctgccttagaccagattacacaagtgcgggccatgctgatggccatgcgggaagaggaaaatagtctccgagccaacctgggcatcttcaagatcgagcagccaccctccaaggaccttcagaacctggagaaggagctcgatgccctccagcaaatctgggagatcgcacgagactgggaggagaactggaatgagtggaagactggccggttcctgatcctgcagacggaaaccatggagaccacggcccacgggctgtttcgtcgcctcacaaaattagccaaagagtataaggaccgaaactgggaaattattgaaaccactcgctcaaaaatagagcagttcaagaggaccatgcctctcatctcagacctgcggaaccctgcccttagagagaggcactgggaccaggtccgggatgagatccagcgggagtttgatcaggaatctgaaagcttcaccttggagcagattgtggagcttgggatggatcagcatgtggagaaaattggggagatctctgcttcagcaactaaagagctggctatagaagtggctttacaaaacattgccaagacctgggatgtgactcagctcgacatagtaccctacaaggataagggccatcatcggctcagaggtacagaagaagtattccaggcactggaagataaccaggtagctctgtctaccatgaaggcatcacgctttgtcaaggcctttgagaaggatgtggaccactgggaacgctgcctctccctcattttggaggttattgagatgattctcacagtgcagcgtcagtggatgtacttagagaatatcttcctaggagaagacatccgcaagcagctgcccaatgaatcgaccttatttgaccaggtcaacagcaactggaaagccatcatggacaggatgaacaaggacaacaatgctctccggagcacccatcacccaggcctcctggacacattgatagaaatgaatacaatcctggaagatattcagaaatctctggatatgtatttagagaccaagcgacatattttcccccgcttctacttcttgtccaatgatgacctgctggagattctgggccagtcccgaaacccagaggctgtgcagccacacctcaaaaaatgctttgacaacatcaagttgctgagaatccagaaggttggagggcccagcagcaaatgggaagctgtggggatgttctcgggcgacggcgagtacattgacttcctccactcagtatttttagaaggccctgtggagtcctggcttggcgatgtggaacagaccatgagggtgaccctgcgggaccttctccggaactgccacctggccctcaggaagttcctcaacaagagggacaaatgggtgaaggagtgggctggccaggtggtgatcactgccagtcagatccagtggacggctgatgtcaccaagtgcctgctgacagcgaaggagcgggcagacaagaaaatcctcaaggtcatgaagaagaaccaggtgtcaatcctgaataagtattcagaagccatcagggggaacttgaccaagatcatgcggcttaaaattgtggctctggtgacgatagaaattcatgcccgggatgtgttggagaagctttacaagagtggcctcatggatgtcaattcctttgactggctcagccaacttcggttctactgggagaaggatcttgatgactgtgtcatccgccagaccaacacgcaatttcagtataattatgagtacttgggtaactcgggccggctcgtcatcacccccctgacggacaggtgttacatgacactgaccacggcattgcacctgcaccgagggggctcccccaaaggccctgcaggcacaggcaagaccgagaccgtcaaggacctgggcaaggccctgggcatatatgtcattgtggtcaactgctctgagggcctggactacaagtccatgggccgaatgtactcaggtctggcccagactggagcttggggctgctttgatgagtttaaccgcatcaacatcgaggtgctgtcagtggtggcccaccagatcctgtgcatcctgtctgccctggctgccggcctcacccatttccattttgatggctttgaaataaatctggtgtggtcctgtgggatcttcattaccatgaatcctggctatgctggccgcacagagcttcccgaaaatcttaaatccatgttccgcccaattgccatggtggtgcctgactccaccctcattgcagaaatcattctctttggagagggctttggcaactgcaagattctggccaagaaggtgtacacactctactcactggctgtgcagcagctgtccagacaggaccactatgactttggcctgcgtgccctcacctcccttctgcgctatgctggcaagaagcgccgcctacagccggatctgactgatgaagaggttctgctgctctcaatgagagatatgaacatcgccaagctcacttcagttgatgcacccctgttcaatgccatcgtgcaagatctgtttcccaacattgagctgcctgtcattgactatggcaagctgcgggagaccgttgagcaggagattcgagacatgggcctgcaaagcacgccgttcaccctcaccaaggttttccagttgtatgaaaccaagaactcccgccactccaccatgatcgtgggctgcacgggcagcggcaagactgcctcatggcgcattctacaggcctccctgtcctctctgtgccgcgccggagaccctaacttcaacattgttagagagttccctttgaaccccaaggcattgtccctaggggaactgtatggggaatatgacctcagcaccaatgaatggacagatggcatcttgtccagtgtcatgcggacggcatgtgcagatgagaaacccgacgagaagtggatcctgttcgatggccccgtggacacactgtggatcgagaacatgaactccgtcatggacgataacaaggtgttgaccctcatcaacggcgagcgcatcgcgatgcccgagcaggtgtctctcctgtttgaagtggaggacctggcaatggcctctccggccactgtatcccgctgcgggatggtctacactgactacgctgacctgggctggaagccctatgttcagtcatggctggagaagaggccaaaggctgaggtggagccccttcaacgcatgttcgaaaagctcatcaacaagatgctggcctttaagaaggacaactgcaaggagctggtgcccctgcccgagtacagcggtatcacctccctctgcaagctgtactctgccctggccacgccagagaatggggtgaacccagctgacggcgagaactatgtcaccatggtagagatgacatttgtgttcagcatgatctggtctgtgtgtgcctctgtggatgaggagggccggaagaggatcgacagctacctccgagagatcgagggctcctttcccaataaggacacggtatatgagtattttgtggaccccaaaatacggagttggacatcatttgaggacaagctccctaagagttggcgctaccctccaaacgcccccttctataagatcatggtgcccaccgtcgacactgttcgctacaactacctggtgagcagcttggtggccaaccagaatcccattctgctggtgggtcccgtggggactgggaagacctccatcgcccagagcgttctgcagtccctgccctccagccagtggtcggtgctcgttgtcaacatgtccgcacagaccacatccaataacgtgcagagcatcattgagagcagggttgagaagcgaaccaagggtgtctacgtgccattcgggggcaaaagcatgatcacctttatggatgacctaaatatgcccgctaaggacatgtttgggtcccagccacccctggagctgatccgcctctggattgactatggcttctggtatgaccgtacgaagcagaccatcaagtacattcgagaaatgttcctgatggctgccatgggcccccctgggggtggacggactgtcatctccccaaggctacggagtcgcttcaacattatcaacatgaccttccccacaaagtcccagatcatccgcatattcggcaccatgatcaatcagaagcttcaggactttgaggaagaggtgaagcccattgggaacgtggtgacagaggccaccctggacatgtacaacaccgtggtacagcgcttcctgcccacgcccaccaagatgcattacctcttcaaccttcgagacatctccaaggtgttccagggcatgcttagagccaacaaggacttccatgataccaagtccagcatcacacggctctggatccatgaatgtttcagagtcttctctgaccggctggttgatgcggcagacacagaagccttcatgggcatcataagcgacaagctcggctccttctttgacctcacatttcatcatctctgtcccagcaagcgtcctcctatctttggggatttcctgaaggagcccaaggtgtatgaagacctcacggatctgacagtgctgaagacagtcatggagacagctctaaatgagtataacctgtcaccctctgtcgtgcccatgcagctagtgctcttccgagaggctattgaacacatcacacggatcgtgcgggtcattggacagcctcggggcaacatgctcctggtgggtatcgggggcagcggacgccagagtctggcccgcctggcttcatccatctgcgactacaccaccttccagatcgaggtcaccaaacattatcggaagcaggagttccgagatgatatcaagcgtctgtatcgccaggctggggtggagctcaagaccacgtccttcatttttgtggacacccaaatagctgatgagtccttcctagaggacatcaacaacatcctcagctcaggcgaggtgcccaatctctacaagcctgatgaatttgaagagatccagtcgcatatcatagaccaggcccgggtggagcaggtgcctgagtcatcggacagcctcttcgcctacctcattgaacgcgtgcagaacaacctgcacatcgtgctctgcctcagccccatgggggatcccttcaggaactggatccgccagtacccagccttggtgaactgcacaaccatcaactggttctcagagtggccccaagaggccctgctcgaggtggctgagaagtgcctcataggagtagacctgggaactcaggagaatatccacaggaaggtggcccagatctttgtcactatgcactggtcagtagctcagtattcccagaagatgctgttggaactgcggagacacaactatgtcacacccaccaaatacctggaactcctgtctggatataagaagttgctgggagaaaaacggcaggagctgctggcccaagccaataaactgcggacaggcttgttcaagatcgacgaaactagggaaaaggtgcaagtgatgtcgttggagctggaggatgccaagaagaaggtggctgagttccagaagcagtgtgaggagtacctggtcatcattgtgcagcagaagcgggaggcagatgagcagcagaaggccgtaacagccaacagtgaaaagattgcagttgaggaaatcaagtgtcaggcactggctgacaatgcccagaaagatctagaagaggcactgcccgccctggaagaggccatgcgggccctggagtctctgaacaagaaggatataggagagatcaagtcttatggacggcccccagcccaagtggagatagtgatgcaggcagttatgattcttcgaggcaacgagcccacatgggcagaggccaagaggcagctaggggaacagaacttcatcaagtcactgatcaactttgataaagacaatatctcagataaggttctgaagaagattggggcctactgcgcccagcctgacttccagcctgatatcatcggccgcgtctccctggctgccaagtccctctgcatgtgggtgcgggccatggagctgtatgggcggctatatcgggtggtggagcccaagcgaatccgaatgaacgctgccttggctcagcttcgggagaagcaagccgcgctcgctgaggcccaggagaagctgcgggaggtagctgagaaactggagatgctaaagaaacagtatgatgagaagctggcacagaaggaggagcttcgcaagaagtctgaagagatggagctgaagctggagcgagctgggatgctcgtgtcggggttggctggcgagaaggccagatgggaggagacagtccagggcctggaggaggacctgggctacctggtgggggactgtctcctggcagctgccttcctgtcctacatgggacccttcctgaccaactaccgggatgagattgtcaaccaaatctggatcgggaagatctgggagcttcaggttccttgctccccttctttcgccatcgataacttcctgtgcaatcctaccaaagtccgggactggaacatccaagggttgccctcagacgccttctccactgagaatggcatcatcgtcacccgaggcaacaggtgggcactgatgatcgaccctcaggcccaggccctgaaatggattaagaacatggaaggaggccagggcctgaagatcatcgacctgcagatgagcgattacctgcgaatcctagaacacgccattcactttggatacccggtgctacttcagaacgtgcaggaatatctggaccccacactgaaccccatgctcaacaaatctgtagcccgaatcggtggtcggctgttgatgcgcattggcgataaggaggtggaatataataccaatttccgtttctacatcaccaccaagctctccaacccccactacagcccagagacctcagccaagaccaccatcgtcaactttgctgttaaagaacagggcctggaggcccagctgctgggcattgtggtgcggaaggagcggcctgagctggaggagcagaaggactcactggtcatcaacatcgcggctggtaaaaggaagctcaaggagctggaggatgagatcctgcggctgctgaatgaggccaccggctccctgctggatgatgtgcagctggtgaacacgctgcatacctccaagatcacagccacagaggtgactgagcagctggagaccagtgagaccacagagatcaacactgacttggcgcgggaggcttaccgcccatgcgcccagcgggcatcaatcctgttcttcgtgctcaatgatatgggctgcatcgaccccatgtaccagttctcactggatgcctacatcagcctctttattctcagcattgacaaaagccaccgcagcaataagctggaggaccgcattgactacctgaatgactaccacacctacgctgtctacaggtacacctgccgtacccttttcgaacgccacaaactactattcagttttcatatgtgtgccaaaatcttggagacttctggcaagctcaacatggatgaatacaacttctttctacgtgggggtgtggtcttggatcgggagggccaaatggacaatccatgtagtagctggcttgcagatgcctactgggataacatcacagagctagacaaactgaccaacttccacggactcatgaactcctttgagcagtaccctcgtgactggcacctgtggtataccaatgctgccccggagaaggcgatgctgccaggtgagtgggaaaatgcctgcaatgaaatgcaacggatgctgatcgttcgctccctgcgccaggaccgcgtggccttctgcgtgacctccttcatcatcaccaaccttggctcccgcttcatcgagccgcctgtgctgaatatgaagtcggtgctggaggattcaaccccacgatccccactcgtgttcatcctgtcccctggtgtggaccccaccagtgccctgctgcagctggcagagcacatgggcatggcccagcgcttccacgccctgtccctgggccagggccaggcccccatcgctgctcggctcctccgagagggtgtgactcagggacactgggtgttcctggcaaactgccacctgtcactgtcttggatgcctaatctggacaagctggtggagcagctgcaggtggaggatcctcatccatccttccgcctctggctcagctccatcccccacccagacttccctatctcaatcttgcaggtcagcatcaagatgaccacagagccaccaaagggcctaaaggccaacatgacacgtctttaccaactgatgtcagaaccacagttttcccgctgctccaaacctgccaaatataagaagctgctgttttcactctgtttcttccactctgtgttacttgaacgcaaaaagttcctgcagcttggctggaacatcatctatggcttcaatgactccgactttgaggtgtcagaaaacttgctgagcctctatctcgatgagtacgaggagacaccttgggacgcacttaagtacctcattgccggcatcaactatggtggacatgtcacagatgactgggaccggcgcctgctgaccacctacatcaatgattatttctgtgaccagtctctatcaactcccttccaccggttgtcagcactggagacttatttcatccccaaggatggcagcctcgcttcttacaaggaatacatcagcttattgcctggcatggacccccctgaggcctttggccagcaccccaatgctgatgtggcctctcagatcactgaggcacaaaccctctttgatactttgctttccttgcaacctcagattacacccaccagggctggaggccagacccgggaagagaaggtccttgagttggccgctgatgtgaagcagaagatccctgaaatgatcgactatgaggggactcaaaaactgctagctctcgacccctcccccctcaatgtggtccttctgcaggagatccagagatacaacacactgatgcagaccatcctgttctcactgacagacctagagaaaggcatccagggtctcatcgtcatgtctacaagcctggaagagattttcaattgcatctttgatgcccatgttcctccgctctggggaaaggcatacccctcacaaaagccattggctgcctggacccgggacttggccatgcgtgtggagcagtttgagctgtgggccagccgggcccggcctcctgtgatcttctggttgtctggtttcacctttcccactggcttcctcactgctgtgctgcagtcttcagctcgccaaaacaacgtttcagtggacagcctctcctgggagtttatcgtttccactgtggatgacagcaacctagtgtatccccccaaggatggtgtctgggtccggggcctgtacctggaaggtgctggctgggaccggaagaactcctgcttggtggaggcagagcccatgcagcttgtctgcctcatgcccacgatccacttccggcctgcagagagccgcaagaagagcgccaagggcatgtactcctgcccctgctattactatcccaaccgggcaggcagctcagaccgagcctcctttgtcatcggcattgacctgcggtctggggccatgacacctgatcattggatcaagaggggcactgctctactcatgagcctggacagctgagacctcctcctcttctccgcttgagagagagggtcagggactccaggagctaagacagatgttgcacctaggactgaggccggacctcactcagactttgaccttggccgaatttgtgtgatgtggccctggagatacctagttgtgttagccataaaagtgaaagagttgtattggagctcagtgctgtaaaacacccgcgacaacaagc

SEQ ID NO: 128530 - DNA, 2994 bp, Homo sapiens
  Payload ID: 5156
  Gene Symbol: DNAH2
  Gene Name: dynein, axonemal, heavy chain 2
  Uniprot ID: Q9P225
  ENST ID: ENST00000570791
  CDS Start-End: 86-2704
agggctgcgaggggcaacttcttagagtggcccatcggtcggtctagggaggggagggtcagcgtggcaaggttttgcctgcacgatgtccagcaaagctgagaagaagcagcgattgagtggccgaggaagctcccaggcaagctggtcagggcgggccactcgggctgctgtggccacacaggagcaggggaatgccccggctgtcagtgagccagagctgcaggctgagctccccaaggaggagcctgagccacggttggagggacctcaagcacagagtgaagaatcagtggagcccgaggcagatgtgaagcccctcttcctttcccgagctgcgctgacaggactggcggatgcagtgtggacacaggagcatgatgccattctggaacactttgcccaggaccctacagaatccatcctcaccatcttcattgacccttgttttgggctgaagctagagctgggcatgcctgtacagacccagaaccagcttgtctacttcattcgccaagcaccagttcccatcacctgggagaacttcgaggcaactgtgcagtttgggacggtgcggggcccctatatcccggccctgcttcggctgctcggtggagtctttgcccctcagatctttgcaaacacaggctggcctgagagcattagaaatcattttgcttctcatctgcacaagttcttggcctgcctgacagacactcggtacaaactggaggggcacacggtcctctacatccctgcagaggccatgaacatgaagcctgagatggtgataaaggacaaagagctggtgcaacggctagagacctccatgatccactggacccggcagataaaggagatgctcagtgcccaggagactgtggagacaggagaaaatttaggtcctctggaggagattgagttctggcgcaaccgatgcatggacctgtctggcatcagtaagcagctggtgaagaagggagtgaagcacgttgaatccatcctgcaccttgccaagtcgtcctacttggcgccctttatgaaactggcacagcagatccaggatggctctcgtcaagcacagtcaaacctgacctttttgtcaatcctgaaggaaccttaccaggagttggctttcatgaagcccaaggacatctctagcaagctccctaagctgatcagtctcatccgcatcatctgggtcaactctccccactacaacactcgggagagactgacctcgctcttccgaaagatgagcaatgagatcatccgcttatgctgccacgccatctccctggaccggatctttgagggatatgtctcttccagcaaggaggacctgcaaggctgcattctctgttgtcacgcttggaaagatcactacgtacaggctgtgcagatgcacatccagttctccagtcggggctgggtcctagatcagaccagcatctttgctcaggttgatgcctttgtgcagcgctgcaaggaccttattgaggtatgtgactgtcagtatcacttcgcccgctgggaagatggcaagcagggtccccttccttgcttctttggtgcccaggggccacagataacacggaacttgctggagattgaggacatctttcataaaaatctgcacacgctgcgagccgttcgcgggggtatcctggatgtcaagaacacctgttggcatgaagactacaataagttccgtgccggaatcaaggacctggaggtgatgacccagaacctgatcacctcagccttcgagttggtgcgggacgtgccgcacggcgtgcttctgctggacaccttccacaggcttgcctcccgcgaggctatcaagcggacttatgacaagaaggcggtggatctctacatgctgttcaatagcgagctggccctggtgaaccgtgaacggaacaagaaatggccagacctggagccctacgtggcccagtattccggaaaggcgcgctgggtgcacatcctccggcgtcgcatcgacagagtcatgacctgccttgctggtgctcatttcctgccccgtattgggactggaaaggagagtgtgcacacctatcagcagatggtccaggccattgatgagctggttcgaaaaaccttccaagagtggacatcaagtctggacaaggattgcattcggcggttggataccccattgctgcgaatcagccaggagaaggcgggcatgctggatgtcaactttgacaagtacaggagccacctggccccttttccctatactccccttctgcagctctcccaagaatttcactcccatcttttgactcctctcttcattattctctctctttctcatacaatatgtttgctatcgtcattttacttttttttttcttcttttatttttgtctctccccacctcccaccctgctatcaacattttaattttacaacttatcttaaaacacaacaaaacaaaacaatgatcggccaggcacggtggctcacacctgtaatcccagcactttgggaggctgaggtgggcgcatcgcttgagcccaggagtttgagaacagcctgggcaacatggcaaaacccagtctctgcaaaaaatacaaagattagctgggcgtggtggcacaagcctgtagtctcagctacttgggagggtgaggtgggaggatcgcctgagcccgggaggcagaggctgcagtgagctgagatcacaccactacactccagcctgggcgacagagtgaccctgcctcaaaaacaaaaatcaaaaaccactccactatctgactaaaccagtgatgtcgctgttctgccactagatggccataatggctcagctaagtcacccaaaccctgtccctttcctgactgttggtggggctgtcagaccatgccttcttctacagcttcattgttatgaaactgtcatactataattatttaaaatgtaattaatcaattaactaatttattaaaaatatatagtgagca

SEQ ID NO: 128531 - DNA, 4707 bp, Homo sapiens
  Payload ID: 5156
  Gene Symbol: DNAH2
  Gene Name: dynein, axonemal, heavy chain 2
  ENST ID: ENST00000574518
  CDS Start-End: 1-784
agatgaggacatcaagaagatccagacccaaatcagcagcggcatgactaacaacgcaagcctgctgcagaactacctcaagacctgggacatgtaccgggagatctgggagatcaacaaggactccttcattcatcgctaccagcgcctcaaccctcctgtctcttcttttgttgccgacattgcccgctacacggaagttgctaataacgtgcagaaggaggagacagtcaccaacatccagtttgtgctgctggactgttcgcacctcaagttctccctggtgcagcactgcaatgaatggcagaacaagttcgcgactctgctcagggagatggctgctgggcgcctcctggagctgcacacctacctgaaggagaacgcagagaaaatcagccgccctccgcagacactggaggaactgggggtcagcttgcagctcgtggatgccctgaagcacgacttggccaacgtggagactcagatccctcccatacacgagcaatttgccattcttgaaaagtacgaggtgccagtcgaggacagtgtcctggagatgctggacagtctcaacggggagtgggttgtcttccaacaaactctgctggacagtaagcaaatgctgaagaaacacaaggagaaattcaagacaggcctgatccactcggcagatgacttcaagaagaaagcacatacacttctggaagatttcgaattcaaaggagctcgatgccctccagcaaatctgggagatcgcacgagactgggaggagaactggaatgagtggaagactggccggttcctgatcctgcagacggaaaccatggagaccacggcccacgggctgtttcgtcgcctcacaaaattagccaaagagtataaggaccgaaactgggaaattattgaaaccactcgctcaaaaatagagcagttcaagaggaccatgcctctcatctcagacctgcggaaccctgcccttagagagaggcactgggaccaggtccgggatgagatccagcgggagtttgatcaggaatctgaaagcttcaccttggagcagattgtggagcttgggatggatcagcatgtggagaaaattggggagatctctgcttcagcaactaaagagctggctatagaagtggctttacaaaacattgccaagacctgggatgtgactcagctcgacatagtaccctacaaggataagggccatcatcggctcaggtcaggggagctggggctctaggagaatggagggctgtgtgacccaggctgcagagtgggaccaaggttgggcaggtggggatgaactatgattttgaccccttgtgtctcagaggtacagaagaagtattccaggcactggaagataaccaggtagctctgtctaccatgaaggcatcacgctttgtcaaggcctttgagaaggatgtggaccactgggaacgctgcctctccctcattttggaggttattgagatgattctcacagtgcagcgtcagtggatgtacttagagaatatcttcctaggagaagacatccgcaagcagctgcccaatgaatcgaccttatttgaccaggtcaacagcaactggaaagccatcatggacaggatgaacaaggacaacaatgctctccggagcacccatcacccaggcctcctggacacattgatagaaatgaatacaatcctggaagatattcagaaatctctggatatgtatttagagaccaagcgacatattttcccccgcttctacttcttgtccaatgatgacctgctggagattctgggccagtcccgaaacccagaggctgtgcagccacacctcaaaaaatgctttgacaacatcaagttgctgagaatccagaaggttggagggcccagcagcaaatgggaagctgtggggatgttctcgggcgacggcgagtacattgacttcctccactcagtatttttagaaggccctgtggagtcctggcttggcgatgtggaacagaccatgagggtgaccctgcgggaccttctccggaactgccacctggccctcaggaagttcctcaacaagagggacaaatgggtgaaggagtgggctggccaggtggtgatcactgccagtcagatccagtggacggctgatgtcaccaagtgcctgctgacagcgaaggagcgggcagacaagaaaatcctcaaggtcatgaagaagaaccaggtgtcaatcctgaataagtattcagaagccatcagggggaacttgaccaagatcatgcggcttaaaattgtggctctggtgacgatagaaattcatgcccgggatgtgttggagaagctttacaagagtggcctcatggatgtcaattcctttgactggctcagccaacttcggttctactgggagaaggatcttgatgactgtgtcatccgccagaccaacacgcaatttcagtataattatgagtacttgggtaactcgggccggctcgtcatcacccccctgacggacaggtgttacatgacactgaccacggcattgcacctgcaccgagggggctcccccaaaggccctgcaggcacaggcaagaccgagaccgtcaaggacctgggcaaggccctgggcatatatgtcattgtggtcaactgctctgagggcctggactacaagtccatgggccgaatgtactcaggtctggcccagactggagcttggggctgctttgatgagtttaaccgcatcaacatcgaggtgctgtcagtggtggcccaccagatcctgtgcatcctgtctgccctggctgccggcctcacccatttccattttgatggctttgaaataaatctggtgtggtcctgtgggatcttcattaccatgaatcctggctatgctggccgcacagagcttcccgaaaatcttaaatccatgttccgcccaattgccatggtggtgcctgactccaccctcattgcagaaatcattctctttggagagggctttggcaactgcaagattctggccaagaaggtgtacacactctactcactggctgtgcagcagctgtccagacaggaccactatgactttggcctgcgtgccctcacctcccttctgcgctatgctggcaagaagcgccgcctacagccggatctgactgatgaagaggttctgctgctctcaatgagagatatgaacatcgccaagctcacttcagttgatgcacccctgttcaatgccatcgtgcaagatctgtttcccaacattgagctgcctgtcattgactatggcaagctgcgggagaccgttgagcaggagattcgagacatgggcctgcaaagcacgccgttcaccctcaccaaggttttccagttgtatgaaaccaagaactcccgccactccaccatgatcgtgggctgcacgggcagcggcaagactgcctcatggcgcattctacaggcctccctgtcctctctgtgccgcgccggagaccctaacttcaacattgttagagtacggggctgggacagtggagtcagtgggcagagacttgagtagtaagaagacaatggagggtgggggccagggaggaccttgcaaggccgggagagctgtacctgggaccatggtggcctggagcgatgagagaagggacaaatgcacgtacctaagaggggtctggaaataaagaggggtttttgtccatcagcagctaaaaccccttccggtgtcattttcaggagttccctttgaaccccaaggcattgtccctaggggaactgtatggggaatatgacctcagcaccaatgaatggacagatggcatcttgtccagtgtcatgcggacggcatgtgcagatgagaaacccgacgagaagtggatcctgttcgatggccccgtggacacactgtggatcgagaacatgaactccgtcatggacgataacaaggtgttgaccctcatcaacggcgagcgcatcgcgatgcccgagcaggtcagggacgcggctgactcctggaggcctgcagaggcaggcaccggagggcgtgggccggggctggggaggagagccagaaatctcagagcagggcaggttctgtgggagagagctgaaaggtggatgcctggattcagggaaacctgcagctgaagaaaaatgctttgcttgccgcggctgttgagaacaatgataagaaaaacaccctctgttgtaagcactgtgtaggcttgggcggccctcctcggctcgttctcacggatgcatgaggcaggaccctcgtttgtgcacccagaggtatgaattcacggactggcaagcacacccttttccacccactccaacaatgcgagcaagagagtgatttttcaaaaggacaaccttgaataagctctagtttcttttaaagcaaactgggccgggccgggtggctcacgcctgtaatcctagcactttgggaggccaaggtgggcagatcacttgaggtcaggagttcaagaccagcctggccaacagggtaaaaccccatctctactaaaaaatacaaaagttagctgggtgtggtgttgtgcacctgtagtcccaggtactctggaggctgaggtgggaggattgcttgaacctgagaggcggaggttgcagtcagccaagatcacgccactgcactccagcctgggtgacggagtgagactttgtcttaaaaaaaaaaaaaaa

SEQ ID NO: 128532 - DNA, 3476 bp, Homo sapiens
  Payload ID: 5156
  Gene Symbol: DNAH2
  Gene Name: dynein, axonemal, heavy chain 2
  ENST ID: ENST00000575105
  CDS Start-End: 1-3476
aagatcgacgaaactagggaaaaggtgcaagtgatgtcgttggagctggaggatgccaagaagaaggtggctgagttccagaagcagtgtgaggagtacctggtcatcattgtgcagcagaagcgggaggcagatgagcagcagaaggccctggagtctctgaacaagaaggatataggagagatcaagtcttatggacggcccccagcccaagtggagatagtgatgcaggcagttatgattcttcgaggcaacgagcccacatgggcagaggccaagaggcagctaggggaacagaacttcatcaagtcactgatcaactttgataaagacaatatctcagataaggttctgaagaagattggggcctactgcgcccagcctgacttccagcctgatatcatcggccgcgtctccctggctgccaagtccctctgcatgtgggtgcgggccatggagctgtatgggcggctatatcgggtggtggagcccaagcgaatccgaatgaacgctgccttggctcagcttcgggagaagcaagccgcgctcgctgaggcccaggagaagctgcgggaggtagctgagaaactggagatgctaaagaaacagtatgatgagaagctggcacagaaggaggagcttcgcaagaagtctgaagagatggagctgaagctggagcgagctgggatgctcgtgtcggggttggctggcgagaaggccagatgggaggagacagtccagggcctggaggaggacctgggctacctggtgggggactgtctcctggcagctgccttcctgtcctacatgggacccttcctgaccaactaccgggatgagattgtcaaccaaatctggatcgggaagatctgggagcttcaggttccttgctccccttctttcgccatcgataacttcctgtgcaatcctaccaaagtccgggactggaacatccaagggttgccctcagacgccttctccactgagaatggcatcatcgtcacccgaggcaacaggtgggcactgatgatcgaccctcaggcccaggccctgaaatggattaagaacatggaaggaggccagggcctgaagatcatcgacctgcagatgagcgattacctgcgaatcctagaacacgccattcactttggatacccggtgctacttcagaacgtgcaggaatatctggaccccacactgaaccccatgctcaacaaatctgtagcccgaatcggtggtcggctgttgatgcgcattggcgataaggaggtggaatataataccaatttccgtttctacatcaccaccaagctctccaacccccactacagcccagagacctcagccaagaccaccatcgtcaactttgctgttaaagaacagggcctggaggcccagctgctgggcattgtggtgcggaaggagcggcctgagctggaggagcagaaggactcactggtcatcaacatcgcggctggtaaaaggaagctcaaggagctggaggatgagatcctgcggctgctgaatgaggccaccggctccctgctggatgatgtgcagctggtgaacacgctgcatacctccaagatcacagccacagaggtgactgagcagctggagaccagtgagaccacagagatcaacactgacttggcgcgggaggcttaccgcccatgcgcccagcgggcatcaatcctgttcttcgtgctcaatgatatgggctgcatcgaccccatgtaccagttctcactggatgcctacatcagcctctttattctcagcattgacaaaagccaccgcagcaataagctggaggaccgcattgactacctgaatgactaccacacctacgctgtctacaggtacacctgccgtacccttttcgaacgccacaaactactattcagttttcatatgtgtgccaaaatcttggagacttctggcaagctcaacatggatgaatacaacttctttctacgtgggggtgtggtcttggatcgggagggccaaatggacaatccatgtagtagctggcttgcagatgcctactgggataacatcacagagctagacaaactgaccaacttccacggactcatgaactcctttgagcagtaccctcgtgactggcacctgtggtataccaatgctgccccggagaaggcgatgctgccaggtgagtgggaaaatgcctgcaatgaaatgcaacggatgctgatcgttcgctccctgcgccaggaccgcgtggccttctgcgtgacctccttcatcatcaccaaccttggctcccgcttcatcgagccgcctgtgctgaatatgaagtcggtgctggaggattcaaccccacgatccccactcgtgttcatcctgtcccctggtgtggaccccaccagtgccctgctgcagctggcagagcacatgggcatggcccagcgcttccacgccctgtccctgggccagggccaggcccccatcgctgctcggctcctccgagagggtgtgactcagggacactgggtgttcctggcaaactgccacctgtcactgtcttggatgcctaatctggacaagctggtggagcagctgcaggtggaggatcctcatccatccttccgcctctggctcagctccatcccccacccagacttccctatctcaatcttgcaggtcagcatcaagatgaccacagagccaccaaagggcctaaaggccaacatgacacgtctttaccaactgatgtcagaaccacagttttcccgctgctccaaacctgccaaatataagaagctgctgttttcactctgtttcttccactctgtgttacttgaacgcaaaaagttcctgcagcttggctggaacatcatctatggcttcaatgactccgactttgaggtgtcagaaaacttgctgagcctctatctcgatgagtacgaggagacaccttgggacgcacttaagtacctcattgccggcatcaactatggtggacatgtcacagatgactgggaccggcgcctgctgaccacctacatcaatgattatttctgtgaccagtctctatcaactcccttccaccggttgtcagcactggagacttatttcatccccaaggatggcagcctcgcttcttacaaggaatacatcagcttattgcctggcatggacccccctgaggcctttggccagcaccccaatgctgatgtggcctctcagatcactgaggcacaaaccctctttgatactttgctttccttgcaacctcagattacacccaccagggctggaggccagacccgggaagagaaggtccttgagttggccgctgatgtgaagcagaagatccctgaaatgatcgactatgaggggactcaaaaactgctagctctcgacccctcccccctcaatgtggtccttctgcaggagatccagagatacaacacactgatgcagaccatcctgttctcactgacagacct

SEQ ID NO: 128533 - DNA, 12394 bp, Homo sapiens
  Payload ID: 5157
  Gene Symbol: DNAH3
  Gene Name: dynein, axonemal, heavy chain 3
  Uniprot ID: Q8TD57
  ENST ID: ENST00000261383
  CDS Start-End: 1-12351
atgggagctacagggcgcctcgagctcacactggccgcccctccccatccgggcccagcctttcagcgttcaaaagccagggagacccaaggagaggaggaagggagtgaaatgcagatcgccaaaagtgactccatacatcacatgagccactcccaggggcagccagagctgcctcctctgcctgcttctgctaatgaggaaccgtctggactctatcagactgtcatgtcacacagcttttacccgcccttgatgcaacgcacgtcatggaccttggctgcacccttcaaagaacagcatcaccaccgtggacccagtgattccatcgccaacaactactccttgatggcccaggacctgaagctgaaagatctgctgaaggtctaccaaccggccaccatcagtgtccctagggacaggaccggtcaggggctgccatcatcaggaaatagaagctcatcagagcccatgaggaaaaaaacgaagttttcctccagaaacaaagaggattccactaggatcaagttggccttcaagacgtcaatcttctcacccatgaagaaggaggtaaagacatctttgacgttcccaggaagcagaccaatgagtccagaacagcagctcgatgtcatgttacagcaggagatggaaatggaaagtaaagaaaagaagccatctgaatcggacctggagagatactattactatctgaccaatggaattcgcaaagacatgattgcccctgaggagggtgaagtgatggttcggatttcaaagctgatttctaacacgctgctgacgagtcccttcctggagcccctgatggtggtcctcgtgcaggagaaggagaatgactattactgtagcctcatgaaaagcatcgttgattacatcctcatggacccaatggagagaaaacggctctttattgagagcatcccccgcttgtttcctcaaagagtgatccgggcccctgtgccctggcacagtgtctacaggagcgccaagaagtggaacgaggagcatctgcacacggtgaaccccatgatgctcaggctgaaagaactgtggtttgcagaattcagagacctcaggtttgttcgaacagcagaaatactagcgggaaaattgcctctgcagcctcaggaattttgggatgtgatccagaaacactgcctggaggcacaccagactcttctcaacaagtggatccccacctgcgcccagctttttacctcacggaaggagcactggattcattttgctcccaagagcaactatgactcaagtcgaaacattgaggaatattttgcttctgtggcatcattcatgtcgctgcagcttagggagctggtcattaagtcacttgaggacctcgtttcccttttcatgatacacaaagatgggaatgattttaaggagccctaccaagagatgaagtttttcatacctcagctaatcatgatcaaacttgaagtcagtgaacccattattgtcttcaatccatcttttgatggctgctgggaattaatacgtgactctttcctggaaattattaagaactctaatgggatccccaagctgaaatacataccacttaagttctccttcactgctgctgctgctgatcggcaatgtgtgaaagcagctgagccaggagagcccagcatgcacgcggctgccactgcaatggcagagctgaaaggatataatctgctccttggaactgttaacgcagaagaaaaacttgtttctgattttttgattcaaactttcaaggtatttcagaaaaatcaagttggcccctgcaaatatttaaatgtctacaaaaagtatgttgacttattggataacacggcagagcaaaacatcgctgcgttcctgaaagaaaatcatgacattgatgattttgtgacgaagatcaatgccataaagaaacggagaaatgaaattgcatccatgaacatcaccgtgcctttagccatgttctgccttgatgctacggccctaaatcatgatctctgtgagcgagctcaaaatcttaaagaccatctgattcaattccaagtggatgtaaaccgagacaccaataccagcatttgtaatcagtacagccacatcgcagacaaagtcagtgaggttcctgccaacactaaggagctggtatccctcattgaattcctaaagaaatccagtgctgtcactgtgttcaaactcaggaggcaacttagagatgcaagtgaacggctggagttcctgatggactatgcagacttgccgtaccagattgaagatatctttgacaacagccggaacttgctccttcacaagagggatcaggcagaaatggatctgattaaaagatgctcagaatttgagttgagacttgagggctaccacagagaactggaaagttttaggaagcgcgaagtgatgactacagaagaaatgaagcacaatgttgaaaagcttaatgagctttcaaagaacctaaatcgggcgtttgcagagtttgagttgatcaataaggaggaagagctattggaaaaggagaagagtacttaccctcttctgcaggccatgctgaagaacaaagtaccttatgagcagctgtggtcgacagcctatgagttcagcatcaagtcagaggaatggatgaatggacccctcttcttactgaatgctgagcaaattgcggaggagatagggaatatgtggaggacaacgtataaactgatcaagaccttgtctgatgtgcctgcacccaggcgcttagcagagaatgtgaagatcaagatcgataagttcaagcagtacattcccatcctcagtatttcctgcaacccaggaatgaaagaccgacactggcagcagatcagtgagattgttggctatgagataaagcccaccgaaacgacctgcctctcaaatatgctcgaatttggattcggcaaattcgttgaaaaattggagcccattggtgcagctgccagcaaggaatactctctggagaaaaacttggatagaatgaagttggattgggttaacgtgacgttcagcttcgtgaaatacagggacactgatacaaacatcttgtgtgcaattgatgacattcaaatgctacttgatgatcacgtgataaagacccagaccatgtgtggctccccattcatcaaaccaatagaagcagaatgccggaaatgggaagaaaagctaattcgcatacaagacaatttggatgcctggttgaaatgccaagccacctggctgtacctggaaccaatcttcagttcagaggacatcatagcccagatgccagaagaggggaggaaatttggcattgttgatagttactggaaatcacttatgtcccaagcggtgaaagataacaggattctggtggcagccgaccagccacggatggcagagaagcttcaagaagccaactttctcttggaggacatccagaaagggctgaatgattacttggagaagaagagactattcttccccagattcttcttcctatcaaacgatgagctgctggaaatcttgtccgagacaaaggaccctctccgagtgcagccgcacttgaagaagtgctttgaaggaattgccaagcttgagtttacagacaatctggaaattgtgggcatgatcagctcggaaaaagaaactgttccattcatacagaaaatctacccagctaatgccaagggcatggtggaaaagtggctccagcaggtggagcagatgatgctggccagtatgcgagaagtcattggacttgggattgaagcatatgtcaaggtccctcgaaatcactgggtcttacagtggcctggacaggtggttatctgtgtctcctccatcttttggacccaggaggtgtcccaagccctggcggaaaataccttactggattttctgaaaaagagcaatgatcagattgcgcagattgtccagctggtgcgagggaagctgagcagtggagctcgactcactctcggggccctcacggtcatcgatgtccacgcccgcgacgtggtggccaagttatctgaggacagggtctccgatctgaatgatttccaatggatctcacagctgcgctactactgggtggccaaggatgtgcaggtgcagattatcaccacagaagccttgtatggctatgagtacctgggaaactccccccggctggtgatcacacccctcaccgaccgctgctacaggacactgatgggagctttgaagctgaaccttgggggtgctccagagggtccagctgggactggcaagacagaaaccaccaaagatttggccaaagccttggctaagcagtgtgtggtcttcaactgctccgatggtttggattacaaagctatggggaagttcttcaaggggctggcacaggctggagcatgggcgtgctttgatgagttcaacaggatcgaggtagaagtgctgtctgtggtcgctcagcagatcctcagcatccaacaagccatcattcggaagctaaagacattcatctttgaagggactgagctctctctgaacccaacctgcgctgtgttcatcaccatgaaccccgggtatgctggcagggctgaactgcccgacaatctcaaggccttgttccggacagtggccatgatggtcccagattacgccctcattggagaaatctccctctactccatggggtttctggactccagaagtctcgcccagaagatcgttgcgacctaccgcctgtgctcggaacaactgtcctctcagcatcactatgactacggtatgcgcgctgtcaagtctgtgcttactgccgcaggaaacctgaagctcaagtatccagaggagaatgaaagtgtcctgctgctccgggcattgcttgatgtcaatctggccaagttcttagcgcaagatgtccctctgtttcagggaattatatctgatttatttcctggagttgttcttccaaagccagactatgaagtttttctgaaagtgctgaatgataacatcaaaaagatgaaactccagccagtaccttggtttatagggaaaattatccagatctacgaaatgatgctggtgagacatggctatatgattgtaggagaccccatgggcggcaagacctctgcttataaagtgttggctgcagctctcggcgatttacacgcagccaatcagatggaggagtttgctgtggagtacaagatcatcaaccccaaggctatcacgatggggcagctgtatgggtgctttgaccaagtgagccacgagtggatggatggtgtccttgccaatgctttccgggagcaagcgtcttcactctctgatgatcgcaagtggattatatttgatgggccagtggatgctatttggattgaaaatatgaacactgttctggatgacaataaaaagctgtgtctcatgagtggggaaattatccagatgaactccaagatgagcctgatcttcgagcccgccgacctcgagcaagcctctccagccactgtgagcaggtgtgggatgatctacatggagccccatcaactaggctggaagcccctgaaggattcctacatggacaccctgccctccagtctcaccaaggagcacaaagaattggtcaatgacatgttcatgtggcttgtccagccctgcctggaatttggtcgccttcattgtaaatttgttgtccagacatctcccatccaccttgccttctcaatgatgagactgtactcttctctgcttgatgaaatcagggcagtagaagaggaggaaatggaattaggtgaaggcctgtcaagtcaacagatctttctctggctccaaggactgtttctcttttccttggtgtggaccgtggctggcaccatcaacgcagacagcagaaagaaatttgatgtgtttttccgcaacctgatcatgggcatggatgataaccacccaaggcccaaaagcgtcaaactcaccaaaaacaacatctttccagaaagaggaagcatctatgatttttattttatcaaacaagctagtggacattgggaaacgtggacacagtatatcaccaaagaggaggaaaaagttccagctggtgcaaaggtctcagaactcatcatccccacaatggagacagcccggcagtccttcttcttgaaaacctacttagaccatgagattccaatgctgttcgtgggtcccacaggcactggcaaatcagccatcaccaacaacttccttctccaccttcccaaaaatacgtacctacccaactgcatcaatttctctgccagaacctcagccaatcagacccaggatatcatcatgtccaagctggatcgacgacggaagggccttttcgggcctcccatagggaagaaagcagtggtgtttgtggatgacctcaacatgccagccaaagaggtgtatggggcccagccacccatcgagctcctgaggcagtggattgaccatggttactggtttgacaaaaaagacacaaccaggctggacatcgtggacatgctgctcgtgacagccatggggccccccgggggaggaaggaatgacattactggacgattcactcgccatctgaatatcatttccatcaatgcctttgaggatgacattttaaccaagattttcagttcgattgttgactggcacttcgggaaagggtttgatgtgatgtttttaaggtacggaaagatgctggtccaagctactaagacaatttatagagatgcagtggagaacttcttgccaactccctcgaagtcacattacgtctttaacctgcgggacttctcacgagtgattcaaggggtcctgctgtgccctcacacacacctgcaggatgtagaaaaatgtatccggctttggatccatgaggtttatcgggtcttctatgatcgtctgattgacaaggaggacagacaggtctttttcaacatggtgaaggaaaccacctccaattgcttcaagcagaccatagagaaggtgcttatccacttgtcacccactggaaagatagtcgatgataacattcgaagcctcttctttggagattatttcaagccagaaagtgaccaaaaaatctacgatgagatcactgacctgaaacagctgactgtggtcatggagcactatctggaagaattcaacaacatcagcaaggcccccatgtccctggtcatgttcaggtttgccattgagcacatctctaggatctgccgtgtcctgaagcaggacaaaggccacctgctcctggtgggcatagggggcagcgggcggcaaagtgccgccaaactgtccacattcatgaacgcatacgagctataccagattgagatcaccaagaactacgcaggcaatgactggcgagaagatcttaagaagatcatactgcaggtcggtgtggccaccaagagcaccgtgttcctcttcgccgacaaccagatcaaggatgaatcattcgtggaggacatcaacatgcttctgaacacaggtgacgtgcctaacatcttccctgctgacgagaaggctgacatcgtggagaagatgcagactgcagccaggacccaaggagagaaggttgaagtcactcctctttctatgtataacttctttattgagagggtaattaacaaaatctccttttcattagccatgagtccaataggggatgccttcaggaaccgcctgcggatgttcccttcgctgatcaattgctgtacgattgattggttccagtcctggcccacagatgccctagagttggtggctaacaaatttctagaggatgtggagcttgatgacaacattcgggtagaggtcgtgtccatgtgcaaatatttccaagagagcgtcaagaagctgtcactcgattattacaacaaacttcgaagacacaactatgttacccccacctcctaccttgaattgattctaaccttcaagacgctcctgaatagcaagaggcaagaggtggctatgatgaggaaccgctacctgacaggcttgcagaaactcgactttgcagcttctcaggtagcggttatgcaaagagaactgacagctcttcaacctcaactcatcctcacctccgaggaaactgccaagatgatggtgaaaattgaagcggagacgagagaagctgatggaaagaaacttctggtgcaggcagatgaaaaagaagccaatgttgctgctgccattgcccaaggaatcaagaacgaatgtgagggggacctagctgaggcaatgcctgcactcgaggctgcactagctgctctggacaccctgaacccggccgacatctcgctggtgaagtcgatgcagaacccaccaggccctgtcaaactggtcatggagagcatctgcatcatgaaagggatgaagccagagaggaagccagaccccagtggctccggtaagatgatagaagattactggggggtatccaaaaagattcttggggatctgaaattcttggagagtcttaagacatatgacaaagacaacatccccccactgaccatgaagcggatccgggaaaggtttatcaatcacccggaattccagccagctgtcattaaaaatgtatcgtcggcctgcgagggtctgtgcaagtgggtgagggccatggaggtgtacgatcgcgtggccaaggtggtggctcccaaacgggagcgactgagggaggcagaggggaagctggctgcacagatgcagaagctgaaccagaaaagagcagagctgaagctggtggtagatcggctccaggccctgaatgacgactttgaagagatgaacaccaagaaaaaggacttggaggaaaacattgaaatctgctcccaaaagctggtcagggcagagaaactgatcagtggtcttgggggagagaaggacagatggaccgaagctgcccgacagctggggatccgctatactaatctgactggtgacgtgttgctgtcctcaggaactgtggcttacctgggcgcttttacagtggattatcgggtccagtgccaaaatcagtggttggctgaatgtaaggacaaggtcatccctggcttcagtgacttcagtctcagccacacgttaggggatcccataaaaatccgtgcctggcagattgctgggcttcccgttgactccttctccatcgacaatggcatcattgtatccaattccagacgctgggccttaatgattgaccctcacgggcaggccaataaatggattaagaacatggagaaggcgaataaactggctgtcatcaagttctctgatagcaactacatgaggatgctggaaaacgcgctgcagttaggcacccctgtcttgattgaaaacattggagaagagctggatgcttctatcgaacctatcttgctcaaggcaacattcaaacagcaaggagttgagtacatgaggctgggtgaaaacatcattgaatattccagggattttaagttatacatcacaacccgtttgaggaatccacattacctcccagaagttgccgtgaaggtctgtctcctcaacttcatgatcacccccttgggtctccaagatcaactccttggcatcgtggctgcgaaggagaagccagagctggaagagaaaaagaaccagttgattgtggaaagtgccaagaacaagaagcatctcaaggaaattgaagataagatcttggaggttctctccatgtccaagggtaacatcctggaggatgaaaccgccatcaaagttctgtcctcctccaaagtgctatctgaagagatctcagagaaacagaaagttgcttccatgacagaaacgcagattgacgagactcggatgggctacaagccagtggctgtgcattctgccaccatcttcttttgtatctcggacctggccaacatcgagccgatgtaccagtactccctgacttggttcataaatctctacatgcattccttgacccacagcacgaagagcgaggaactgaatctgcgcatcaagtacatcattgaccatttcaccctgagcatctacaacaacgtgtgccgttctctgtttgagaaggacaagctactcttctctctcctcctgaccatcggcatcatgaaacagaagaaggaaattacggaggaggtgtggtacttccttctcactggaggcatcgcactggataacccctaccccaatccagctccccaatggctgtctgagaaggcatgggcagagattgtccgtgcatctgccttacccaaactgcatggcctgatggagcatttggaacagaacctgggtgaatggaagctgatctatgactcggcctggccccatgaggagcaactccctgggtcttggaagttctctcaaggattggagaagatggtgatccttcgatgtttgcggcctgacaaaatggtgccagcggtccgggagttcattgctgaacatatgggaaagctgtatatcgaagcccctacgttcgatctccagggatcctacaatgattccagctgctgtgcgcctttgatttttgtgttgtctccaagtgcagacccaatggcaggcctgctgaagtttgctgatgatcttggtatgggaggtaccagaacacagaccatctcccttggccaaggccaaggccctattgctgccaaaatgatcaacaatgccatcaaagacgggacctgggtggtcttacagaactgccacctggccgcaagctggatgcctaccctggagaagatttgtgaggaggtgattgttcctgagagcaccaatgccagattcagactctggctaaccagctatccatcagagaagtttccagtcagcattctccagaatggaatcaaaatgaccaatgagccccccaaagggctccgggccaacctgttgcgctcctacctcaatgaccccatctcagatcctgtgttcttccaaagctgtgcaaaggcggtgatgtggcaaaagatgttatttggcctttgtttcttccacgccgttgttcaagagagaagaaacttcggccccctagggtggaatattccctatgaattcaacgaatctgacctgaggattagtatgtggcagatccagatgtttctcaatgactacaaggaggtgccctttgatgctctgacctacctgacaggggaatgtaattacggaggcagagtgactgatgacaaagaccggcgtctcctgctgtcacttctgtccatgttctactgtaaggaaattgaggaggactattactccctcgctcctggagacacttactacatccctcctcatggctcctaccagtcctatatcgactatctcaggaatctccccatcacagcccacccagaagtgttcggcctccatgagaacgcagacatcaccaaagacaaccaggaaaccaaccagctgtttgagggggtcctgctgaccctccctagacagtcaggaggaagtggcaagtcccctcaggaagtggttgaggagttggcacaagacattctctccaagcttcccagagactttgacctggaagaggtcatgaagttgtaccccgtggtctatgaagaatccatgaataccgtcctaaggcaggagctcatcagattcaacaggctgaccaaagtggttcggaggagcctcatcaatcttggccgagccatcaaaggacaggtcctgatgtcctcggagctagaggaagtctttaacagcatgcttgtgggtaaagtgccagccatgtgggcagccaagtcttacccatcactgaagcctctggggggctacgtggctgacctgctggcccgcctgaccttcttccaggaatggattgacaaggggccccctgtggtattttggatctctggattctacttcacacagtcttttttgactggcgtctctcaaaattatgcccggaaatataccatccccattgaccacattggatttgagtttgaggtaaccccacaagaaacagtgatggagaataaccccgaagatggggcctacatcaaagggctcttcttagaaggtgcccgttgggacaggaaaacgatgcagattggggaatctctccccaaaatcctctatgacccactgcccatcatttggctgaaacctggggagagcgcaatgtttctgcatcaggacatctatgtgtgtccagtctacaaaacaagtgcccgcagaggaaccctctccaccacaggccactctaccaactatgtcctctccattgagcttccaacagacatgccccagaagcactggataaaccgaggggtggcctcactgtgccagctggataactgatggcatttgtctcaagacagaaaataaaaagcatttcattctt

SEQ ID NO: 128534 - DNA, 15633 bp, Homo sapiens
  Payload ID: 5158
  Gene Symbol: DNAH5
  Gene Name: dynein, axonemal, heavy chain 5
  Uniprot ID: Q8TE73
  ENST ID: ENST00000265104
  CDS Start-End: 106-13980
agtaaaactttccatttggaagcctgttggatgttgagcaggtctgccaggagttagaagaccattccggaagagctgactccagcctgtccatgcacggctacaatgtttaggattgggaggagacagctctggaagcatagcgtcactcgagttttaacgcaaagactgaagggagagaaggaagccaagcgggctcttttggatgcgaggcataactacttatttgcaattgtggcttcctgtttggacctgaacaaaaccgaagtggaggatgccattcttgaagggaatcagattgaaagaattgatcaactttttgctgttggaggtctccgacacctcatgttttactatcaagatgtggaggaagcagaaacaggacaacttggctctctaggaggggtaaatcttgtttctggaaagattaaaaaacctaaggtgttcgtgaccgagggaaacgatgtggctcttactggggtatgtgtgttcttcatcaggactgacccttccaaagccatcacccctgacaacatccaccaggaggtgagttttaacatgttagatgcggcagatggaggcctgctcaacagtgtgagacgtttgctgtcggacatcttcattcctgctctcagagccacgagccatggctggggcgagctcgagggccttcaggacgcagctaacattcgccaggagttcttgagctccctggaaggctttgtgaacgtcctgtcgggtgcacaggagagtctgaaggagaaggtgaaccttcgaaagtgtgacatacttgaactgaaaaccctaaaggaacctacggactacttgactctagcaaataaccctgagactttgggaaaaatagaggattgcatgaaagtatggatcaaacagacagaacaggttcttgctgaaaacaatcagctgctgaaggaagcggatgacgttgggccacgagcggagctggagcactggaaaaaaagactctccaagtttaactaccttttggaacaattgaaaagcccggatgtgaaggctgtgctggcagtgcttgcggcggccaagtcgaaactgctgaagacttggcgggagatggatattcgaatcactgatgcaactaatgaagcaaaggacaatgtgaaatacttgtatacacttgaaaaatgttgtgaccctttgtacagcagtgatcccctatccatgatggatgctattcctacacttataaatgcaattaaaatgatctatagtatctctcattactataatacctctgagaagatcacatctctgtttgtaaaggtgacaaatcagattatatctgcatgtaaagcctatattaccaataatggaaccgcttccatctggaaccagccacaggatgttgttgaagaaaaaatactatctgcgattaaactgaaacaggaataccagctctgctttcacaagacaaaacaaaagcttaaacaaaatccaaatgcaaaacaatttgattttagcgagatgtatatttttggaaaattcgaaacttttcaccgacgccttgccaagataatagacatctttacaaccctcaagacgtattcagtcctgcaagattccacaattgaagggctggaagacatggccactaaataccagggcattgtggcaaccataaagaaaaaggaatacaatttcctagaccagcggaaaatggattttgaccaagattacgaagagttttgcaagcagactaatgaccttcataacgagttgcggaagttcatggatgttacatttgcaaagattcaaaacacaaatcaagctctaagaatgttgaagaaatttgaaagattgaatatacctaatcttggtattgatgacaaatatcaacttatccttgagaactatggggctgacattgatatgatttcaaagctgtatacaaagcagaaatacgatcctcctctggctcgaaaccagcctcccatcgctggaaagattttgtgggcccgccagctcttccataggattcagcagcccatgcagcttttccagcagcacccagctgtgctaagcacggcagaagccaaacctataattcgcagttacaacaggatggccaaggtcctcctggagtttgaggtcctcttccacagggcgtggcttcggcaaattgaagaaattcatgtaggtcttgaggcttcattattggtgaaggctccaggcacaggggaattgtttgtaaactttgaccctcagatattaatcttatttagagaaacagagtgcatggcccagatgggtctggaagtctctccactggcaacttccctcttccagaaacgagatagatacaaaaggaacttcagtaacatgaagatgatgctagctgaatatcagagagtgaagtcaaaaatacctgctgccattgagcaattgattgtccctcacttggccaaagtggatgaagctctccaacctggcttggctgcactgacctggacatcactgaatattgaggcttatttagaaaacacttttgcaaagatcaaggacctggagttgctgcttgacagggtcaatgatttgattgagttccgcattgatgccattctagaagaaatgagcagcacgcctctttgtcagcttccccaggaggagccactaacctgtgaagagtttctccaaatgacaaaggatctttgtgtaaatggtgcacaaatactacattttaaaagctcattagtggaggaggcagtcaatgagcttgtaaatatgttgctggatgtggaagttttatctgaagaagaaagtgaaaaaatatccaatgagaatagtgttaattacaaaaatgaaagttcagcaaaaagagaagaaggaaattttgacaccttgacatcatctattaatgccagggccaatgccctgcttttgacgacagtcacgaggaaaaagaaagaaactgagatgttaggggaagaagcccgcgagttactctctcatttcaaccatcagaacatggatgctcttctgaaagttacaaggaatacactagaggccattcgcaaacgtattcattcctctcacacaattaacttccgggacagtaacagtgcctctaacatgaagcagaacagtttgcccattttccgggcaagcgtcactctggccattcccaacatcgtcatggcccctgccctggaagatgtacagcagaccctgaacaaagccgtggagtgcatcatcagtgtccctaagggggtcagacagtggagcagtgaactgttgtccaagaaaaagatacaagaaagaaaaatggctgctttgcagagtaatgaagacagtgattctgatgttgaaatgggagaaaatgaacttcaagataccttggagatagcatctgtaaatttacccattcccgtgcaaaccaagaactattataagaatgtttctgaaaacaaagagattgtaaaattagtttctgtgcttagcacaattatcaactccaccaaaaaggaagttattacatccatggattgcttcaaacgctacaatcacatttggcaaaagggaaaagaagaagccattaagacatttattacacagagccccttgctttctgaatttgagtcccagattctctatttccaaaacctagagcaggaaattaatgctgagcctgaatatgtctgtgtgggttccattgctctgtacacagctgacttgaagttcgccctgactgctgagacaaaggcctggatggttgtcattggacgccactgtaacaaaaaataccggagtgagatggaaaacatttttatgcttattgaagaattcaataagaaactaaatcgtccaattaaggacctagatgatattcggattgcaatggcagcgctgaaagaaataagggaggagcaaatctccattgactttcaagtaggacctattgaggaatcttatgccctgcttaacagatatggacttctgatagcaagggaagagatagacaaagttgatacactgcactatgcttgggagaagctgctggcacgtgctggcgaagtccagaataaattagtctcactgcagcccagtttcaagaaagagcttattagtgctgtggaggtattcctccaagattgtcaccagttttatctggactatgatttgaatggtccaatggctagcggcttgaagccccaggaagccagtgacaggcttatcatgtttcagaatcaatttgataatatctatcggaaatacatcacatatactggaggagaggagctttttggcctgccagctacacagtatcctcagcttcttgaaataaagaagcaactaaatcttctacagaaaatatatactctgtacaacagtgtcatagaaactgtaaatagctattatgatattctttggtcagaggtgaatattgaaaaaattaacaatgaactcttagaattccagaacagatgtcgaaagcttccccgggccttgaaggactggcaggcttttttggacctgaagaagatcattgatgatttcagcgagtgttgcccgctgctggaatacatggccagtaaagccatgatggagcggcactgggaaaggataaccaccctcaccgggcacagtctggatgtggggaatgaaagctttaagttaagaaatatcatggaggcacctcttctgaaatataaagaggaaatagaggacatctgtatcagtgcggtgaaagagagagacattgagcaaaagctgaagcaagtgattaatgaatgggacaataaaacattcaccttcggcagctttaaaacccgtggagagctcctcttgagaggagacagtacctcggaaatcatcgccaacatggaggacagcttgatgttgctgggatccctactgagcaacaggtacaatatgccattcaaagcccagattcaaaaatgggtgcagtacctttccaactcaacagacatcatcgagagctggatgacggtgcaaaacctgtggatttatttagaagctgtctttgtgggaggagacattgccaagcagctgcccaaggaagccaagcggttttctaacatagataaatcttgggtgaagatcatgactcgggcacatgaagtgcccagtgtagtccagtgctgtgttggagatgagaccctggggcagctgttaccacacttgctggaccagttggaaatatgccagaaatcccttactgggtacttggagaaaaaacgactgtgctttcctcggtttttcttcgtctcagatcctgcccttctagagattctggggcaggcgtcggactcccacactatacaggcccatttgctgaatgtgtttgacaacattaaatctgtcaagttccacgaaaagatctatgatcgaattctgtcaatttcctctcaagagggtgagacgattgaattggataaacctgtcatggcagagggcaatgtggaagtttggcttaattctcttttggaagaatctcagtcctcattgcatcttgtgattcgccaggcagccgcaaatattcaagaaacaggtttccaactaactgaatttctttcatccttccctgctcaggttggattattaggaattcagatgatatggacacgggattcagaagaagcccttagaaatgccaagtttgataaaaaaatcatgcagaaaactaatcaggctttcctggagctactcaatacattgatagacgtcaccacgagggatctgagttccacggaacgagtgaaatacgagactctgattactattcatgtgcaccaaagggatatctttgatgacctgtgtcatatgcatatcaagagtcccatggactttgagtggctgaaacagtgcagattttactttaacgaagattctgacaagatgatgattcacatcacagatgtggcgttcatataccagaatgaatttttaggctgcactgacaggcttgtaataactccacttacagacagatgttacatcacgctggctcaagctctgggaatgagcatggggggagcccctgctggacctgcaggcacaggcaaaacagaaaccactaaagacatgggacgatgcctcgggaaatacgtcgtggttttcaattgttcagaccagatggatttccgaggacttggacggatttttaagggactggcacagtctggatcctggggttgttttgatgaatttaaccgtattgatctaccagttctctcggttgcagcccagcaaatttccattattctgacatgtaaaaaggagcacaaaaagtcttttatctttactgatggagataatgtgactatgaaccctgaatttgggcttttcttaaccatgaatcctggctatgccggacggcaggaactccctgaaaacttgaagattaatttccgctcagtggccatgatggtgcctgaccgtcagattatcataagggtgaagttggctagttgtggcttcattgacaacgttgttttggccaggaagtttttcacgctctacaaactgtgtgaggagcagctttctaagcaggttcattatgactttggcctgcgtaacattctgtcagttcttcggaccttgggagcagcaaaaagagccaatccaatggatacggagtccacgattgtcatgcgtgtactacgggacatgaatctttctaaactgattgatgaggatgaacccttgtttttgagtttgattgaagatctctttccaaatattcttctggacaaggcaggttaccctgaactggaagcagcaattagtagacaggttgaagaagctggtttaatcaaccatcctccttggaaactgaaggtcatccagctattcgaaacgcagagagtgcgacatgggatgatgactctggggcccagtggggctgggaagaccacctgcatccacaccttgatgagagccatgacagattgtggaaaaccacatcgggaaatgaggatgaatcccaaagcgattactgccccacagatgtttggtcggctggacgttgccacaaatgactggactgatgggatattttctacgctttggaggaaaacattaagagcaaagaaaggggaacatatctggataattcttgatggtccagtagatgccatctggattgaaaatctgaattctgttttggatgataacaaaactctaacccttgccaatggtgatcggattcccatggctccaaactgcaagatcattttcgagcctcataacattgacaatgcttctcctgccaccgtctcaagaaatggaatggttttcatgagctcttctatccttgattggagtcctattcttgagggttttcttaagaaacgctcacctcaagaagcagaaattcttcgtcagctgtacaccgagtctttcccagacttgtatcgcttctgtatccagaacttagaatacaagatggaggtgctggaggcctttgtcatcacacagagcattaacatgcttcaaggcctgattcctctgaaggagcaaggcggggaggtgagccaggctcacctggggcggctgttcgtgttcgcgctgctgtggagcgcgggggcggcgctggagctggacggacggcgccgcctggagctctggctgcgctctcggcccacagggacgctggagctgccgccgccagcggggcccggggacaccgccttcgactactatgtggcgcccgatggtacatggacgcactggaacacgcgtacccaggaatacctgtatccgtctgataccaccccagagtatggttctattctggtgccaaatgttgacaatgtgaggactgactttctaattcaaaccattgctaaacagggcaaggctgtgctattaattggtgaacaaggaacagccaaaacagtaataattaaaggatttatgtcaaaatatgatcctgaatgtcacatgatcaagagtctgaatttttcttctgcaaccaccccactgatgttccagaggacgatagagagctatgtggataaacgaatgggtacaacatatggccctcctgcgggaaagaagatgactgtttttattgatgatgtgaatatgccaataatcaatgagtggggagatcaggttacgaatgagatagtgcgacagctgatggaacaaaatggattctataatctagagaagcctggggagttcaccagcatcgtggacatccagtttttggcagccatgatccatcctggtggtggacgcaatgacataccccaaagactcaagaggcagttctctatatttaattgcacgttgccctctgaagcttctgtggacaagatctttggtgtgattggggtaggccactactgtactcagaggggtttctcagaagaagtgagagattctgtgacaaaattggtgcctctgacacgccgactatggcagatgaccaagattaaaatgcttcctacccctgcaaaattccattatgtgtttaacctacgagatctttctcgggtctggcagggaatgctgaacactacttcagaggtcatcaaggaaccaaatgatctgttaaagctgtggaagcatgagtgtaaacgtgttatagctgaccgtttcacagtgtccagtgatgtgacctggtttgataaggctttagtaagtttggtagaggaggagtttggtgaagagaaaaaactcttggtggattgtggaattgacacatattttgtggatttcttgagagatgcacctgaagctgcaggtgaaacatctgaagaggctgatgctgaaacacctaaaatttatgagccaattgaatcttttagtcacctaaaagagcgtctgaatatgttcctgcagctctataatgagagcatccgtggcgccggcatggacatggtgttctttgcagatgccatggttcacttagtcaagatctctcgtgtcattcgtactcctcagggaaatgccctcctggtcggggtgggcggatcaggaaagcagagcctgacgaggttggcttcattcattgctggctacgtttccttccagatcactctgacgagatcctacaacacatcaaatctgatggaagatctgaaggttttgtatcgaacagctggtcagcaaggcaaaggaatcacttttattttcacagacaatgagattaaagatgagtcatttttggaatatatgaacaatgttttatcatcaggtgaggtctctaacctatttgctcgagatgaaattgatgaaattaatagcgacctggcatcagtcatgaaaaaagaattccccaggtgccttcctaccaatgagaacctgcacgactacttcatgagtcgggtccgacagaaccttcatattgtgctctgcttctcgccagtgggggagaaatttcgaaacagagctttgaagttccctgccctaatttcaggatgcacaattgactggttcagccgatggcccaaagatgctttagttgctgtgtctgaacacttcctcacttcctatgatattgactgcagtttggaaatcaagaaggaggtggtccaatgcatgggctccttccaggatggggtggctgagaagtgtgttgattattttcagagattccgacgttctacccacgtgacgcccaaatcatacctctcctttattcagggctataagttcatatatggagaaaagcatgtggaggtgcggaccctggccaacagaatgaatactggattggaaaagctcaaagaagcttcagagtctgttgcagccttgagtaaagaactggaagcgaaagaaaaggagctacaagtggccaacgataaagccgacatggtcttaaaagaagtgacaatgaaagcacaggctgctgaaaaggtcaaggctgaggtacagaaggtgaaggacagggcccaggccattgtggacagcatctctaaagacaaagccattgctgaagaaaaactggaagcagcaaaaccagctttagaagaggcagaagctgcattgcagaccatcaggccttcggacatcgccactgttcgcacgttgggccgcccccctcacctcatcatgcggatcatggattgcgtactgctgctgtttcaaaggaaagtcagtgctgtgaaaattgacctggaaaaaagctgtaccatgccctcctggcaggaatccttaaaattgatgactgcagggaactttttacagaacttacagcaattcccaaaagacacaatcaatgaagaggtgatagaatttttgagtccttactttgaaatgcctgactataacatcgaaactgctaaacgcgtatgtggaaatgtagctggtctttgttcctggacgaaagctatggcttccttcttttctataaacaaagaagtactgcctctgaaggccaacttggtggtgcaagagaatcgccatctcctggccatgcaggatctgcagaaagcccaggccgagttggatgacaagcaggcggaacttgacgtggtgcaggctgagtatgaacaggccatgactgaaaagcagaccttgcttgaagatgcagagcgatgcagacacaagatgcagacagcttccacgctcatcagtggcttggcaggtgaaaaagaaagatggacagagcaaagccaagagtttgctgcacaaactaaaagacttgtaggggatgtactgttggctacagcttttctatcttattctggtccatttaaccaagagtttcgtgatcttctgttaaatgactggcggaaggaaatgaaagcccggaaaattccatttggaaagaacctaaatctcagtgagatgttgattgatgctcctactattagtgaatggaacctccaaggtctgccaaatgatgacttgtccattcaaaatggaattattgtcacgaaggcatctcgttaccctttgttaattgatccacagactcaaggcaagatctggattaaaaataaagaaagccgaaatgaactccagatcacgtctttaaatcacaagtacttcagaaaccacctggaagacagcctttctcttggaaggcctttgcttattgaagatgttggagaggaactagatccagcactagataatgttttggaaagaaacttcattaaaactgggtctacctttaaggtgaaagttggtgacaaggaagtagatgtgttggatggctttagactctacattaccaccaaattgcctaacccagcctacacccctgagataagtgcccgtacctccatcattgacttcactgtcaccatgaaaggtctagaagatcagttactggggagggtcattctcacagagaagcaggaattggagaaagaaagaactcatctgatggaagatgtaactgcaaacaaaagaaggatgaaggaactagaagataacttgctttaccgcctgacaagtacccaggggtccctggtagaagatgaaagtctcattgtcgtgctgagtaacacaaaaaggacagccgaggaggtgacacagaagctagaaatttctgctgagacagaagttcaaattaactcagcccgggaggaatacagacctgtggctacgcggggcagcatcctctacttcctcattactgagatgcgcttggttaatgagatgtatcagacttcgcttcgccagtttctgggcttatttgacctttccttagccaggtctgtcaagagcccgattacaagcaagaggattgctaatatcatcgagcacatgacctacgaggtttataagtatgctgcccgagggctgtacgaggagcacaaattcctgttcaccttgttgcttaccctaaagattgacatccagaggaaccgagtcaagcatgaagagtttctcactcttattaaaggaggtgcctcattagaccttaaagcttgtcctccaaaaccatcaaaatggatcctggacataacatggctgaatttggtggaacttagcaaactcagacagttttcagatgtccttgaccagatatcgagaaatgagaaaatgtggaaaatttggtttgataaggaaaacccggaggaggaacctcttccaaatgcctatgataaatctcttgactgcttcagacgtcttctccttattagatcctggtgtcctgacagaaccatcgcccaggcccgcaagtacatcgtggactccatgggagaaaaatatgccgaaggtgttattttagacttggagaagacgtgggaggaatctgatccacggacgccactcatctgtctcctgtctatgggctcagaccccacagattccatcattgccttggggaagagattaaaaatagaaacccgttatgtgtccatgggccagggccaggaagtccatgctcggaagctcttgcagcagaccatggcgaacggaggatgggcacttctgcagaactgccatctgggacttgatttcatggatgagctgatggacataatcatagaaactgagcttgtacatgatgcgttccgcctctggatgaccaccgaggctcataagcagtttcccattacactccttcagatgtccattaaatttgccaacgatcctccacaaggactccgggcaggactgaaaagaacatatagtggtgtcagccaagacctgctggacgtgagctctgggtcccagtggaagcccatgctgtacgcagtggctttcctgcactccactgtccaggagaggcgcaagttcggtgccctggggtggaatatcccctacgaatttaaccaagcggactttaatgccactgtgcagttcatccaaaaccacttggatgacatggatgtcaaaaagggtgtctcctggaccaccatccgctacatgataggagagattcaatatggaggcagagtcactgacgactatgataagagattgttgaacacatttgctaaggtttggttcagtgaaaatatgtttggaccagatttcagtttttaccaaggatacaatattccaaaatgcagcacagtggataactatcttcagtatatccagagtttgcctgcctatgacagccctgaggtgtttgggctgcaccccaatgctgacatcacctaccagagcaagctggccaaggacgtgctggacaccatcctaggcatccaacccaaggacacctctggtggaggggatgagacccgggaggcggtggtggcccggctggctgatgatatgctggagaagctgcccccagactatgtcccctttgaagtaaaagagaggctgcagaagatggggccattccagcctatgaacattttcctcaggcaggaaatagacagaatgcaaagggtactcagccttgtccgcagcaccctcactgagctgaaacttgctattgatggcaccatcatcatgagcgaaaatctgcgagatgcattggattgcatgtttgatgctagaatccctgcttggtggaaaaaagcttcttggatttctagtacactgggtttctggtttactgaacttatagaaagaaacagccagtttacctcgtgggttttcaatggccgacctcactgcttttggatgacgggtttttttaacccccagggatttttaactgcaatgcgacaggaaataactcgggccaacaaaggctgggctctggacaatatggtgctttgcaatgaagtcaccaaatggatgaaggacgacatttctgcccctcccacagagggtgtctatgtctatggcttatatcttgaaggtgctggctgggacaagaggaacatgaaactcattgaatcaaagccaaaagtgctctttgagttgatgcctgtcataaggatttatgcagaaaacaatactttacgagatcctcggttttactcctgtcccatctataagaagccagttcgaacggacttgaactacattgccgctgtggatctcaggacagcccagacccctgaacactgggtgctccgtggggttgcccttctgtgtgatgtcaagtaacatgtggggagtgtccccacccaatgctttggaaaatgcaagatctaaattattgtaacctttatttctgtatgactgctggacagtgtatgttaggtcgtttatgcaattaatgagctgcataggttttccccactccttaattggatgcttatattttacttgtttcatcattagtgaccaatgtctgagtttgttgaaaatgttatttagtgatataaaagtaaatttacagcatcctaatgaagtgtggccctcaaatccacagtagtatattttcttcttacttcgctccgaagactgactagggtaagcagacagtatttctctgggaggaattattcttctgttaacgtggcctggtaacagccaagttcttgaaggtaacagggcaagtctgtgctgattttgcttctattgcctttcgtatttaggtcaagttaagagacttattttcagggtttcaagcagccaattaaaaataccttttaaaaaatagaaggaaatagaagaatggattaagaatgtaaatagaaaatttatgtaaacatagagaataaacgtagaacaatgcttaagcctacttataattaataatgaaatactaattgataattcttataataaaaattaaagctaaaagtaaatgatagcatgctctcagtaaaactgatccactcacaaattgctggagcaatgtaaatcaacccaacctttttgtaaaatgattaaatacagaaagagccataaaaatattcacacccttggatctttgttttctctacatcaaggaaacaatttaaaagactgaaaacagtctatataaaattgcatttaataacagaaaaaaatggaaaaatcataaatattcaatagtcaggctatggttaaggaaattaagagatatttggcaaccataaaaaacaattttgaagattccataatatgaaatggtagacccagactgttaagtgaaagatttagtttacaaaatattgagcacactgtgattataacagcaaatatatttgcatgtggacaaagattagatggcaagatagaaaaataagaacagatgtgatagcaagaattatagttggcttgaaaaaatgtgatgatcaggagaaaaaataaaaaaagggtagaaatattagacggtgcgtagggactttctatggacttttattaattaggaaacattatcaaaggaacttttcacgtatttttctttaaattctggttagatgttattaataattcttcatctaacctactgactagaaaatatagtcagtactaaattagaattgtggtttataaacttttggttagctctggatctgtataactgcatttttttggataaacagtttttggtaggtggataccgggagacaagtgtgggtccctctcactgggcttcattctgtggaccaggatcattatttcatgctcatgatcatgagagttaggactgagtggctcctgtgactcccaccatcttagatgatactgttttcttgtgagttctttcttttggtgtggattagtatatcagttgatttgtgtgaattgtggtgaaacaatcatttcattttgaaaagcaagtaatgaaaatgtcaacatcataggaattaataaaatgtttttact

SEQ ID NO: 128535 - DNA, 12666 bp, Homo sapiens
  Payload ID: 5159
  Gene Symbol: DNAH6
  Gene Name: dynein, axonemal, heavy chain 6
  Uniprot ID: Q9C0G6
  ENST ID: ENST00000237449
  CDS Start-End: 9-12485
gagtaaggatgacttttcgggccacagatagtgaatttgacctgacaaatattgaagagtatgccgaaaattctgcactttcaagactgaataatataaaagccaaacaaagagtgagttatgtgacatccacagaaaatgaatctgatacacaaatcctaacgtttaggcacattacaaaagctcaggagaagacaagaaaacgacagcagcctataaaactagagcctttgccagtgctaaaagtctaccaagatcataagcagccagaatacatacatgaacagaaccgatttcagttaatgactgcaggaatcattaaacgtccagtaagcatagcaaaaaaaagttttgccacatcatctactcagtttcttgagcatcaagatgctgtgaaaaaaatgcagattcatcggccctatgttgaggtgttctctccctctcctcctaaactgccacatactggtattggaaaaagaggtctctttgggactagatcttcagcttaccctaagtacacttttcacgaccgagaagaagttgttaaagccaacattcgtgatcccttgcaaatcattaaaataatacgtgaaaatgaacatcttggatttctttatatgatccctgcagtgccaagatcatccattgaatatgatacatataatctaaaagttgtaagttatgagaacatcaataaaaatgactactatactattagccaaagggcagtaacacacatttataatgaagacattgaatttatcgaaattgatcgatgggaacaggaatatctgtatcacagagaactcactaagattcccatattttcactgttccggaaatggaaggcttttagtgtatggaggaagaatgtccgctccaagaaaatcactggatgtcaaaaatctctacaaaaaaatttgttcattgttaatcctcatttgcgaccagctcttcttaaaataaatgaattgtgttatcatttgagttttatgggactttgttatattgaaaagtgtcacacctacaccctgcaggaatttaaggccgcacaagtcatacggctagcagaggtgacagaacgcctaggagaatttcgaaatgaggcaaaatatgtagtcaggagggcttgtcgatttgctttgcgtgctgcaggatttgttcctgatgactgtgcatttggaccttttgaggattatcataaagtgcagagcagtggaagtttcattaatacaccacatgagttgcccacttatggagactctgagaaaatgacatatacagaacaggccagcaaaaggcattattgcatgaggctgacgtgctttattcgtctaaacgactatctaattgagaacacaatgcacatcttaacggtaaatgctgttaattcgcttttgaaccatctcactgacaagctaaaacgaacaccttcagcagatgtcattcagaaatggattactgaagagaagcctgaagtccctgataaaaaggggacccttatggtggaaaagcaagaagaagatgaatctctcatccccatgtttctcacagaactaatgttgacagtccagtcactgctctttgagccttctctggaagactttctggatggtattttgggtgcagttaatcactgtcaaaacactgtgttatcagttcctaatctcgtgcctgattcgtattttgatgctttcaccagcccttatattaacaacaaacttgaaggaaaaacctgtggaactgggccaagtttagcagcagtatttgaggatgataagaattttcacacaattatttctcaaataaaggaaaccattcaggccgcatttgaatcagcccgcatctatgcagctacctttgaaaagttccagatattcttcaaggaaaatgaaagtcttgatttacaagctcttaaacttcaggaacctgatattaacttttttagtgaacaactggaaaaatatcacaaacagcacaaggacgcagtagcgctcagacccaccagaaatgtaggattgctgctcattgatactaggcttctaagagaaaaattaattccatcacctttgcgatgcttagaggtgctaaattttatgcttcctcgtcaaagcaagaaaaaagtggatgccattatctttgaggcacaagatgcagagtataaacttgagtttgttccaactactaccacagaatatgttcatagcttattatttcttgatgaaattcaggaacggattgaaagccttgaagatgaggggaatatagtgactcaaatgtacaagcttatggaacaatatcaggtgcccacacctcctgaagactttgctgtttttgcaactatgaagccatccattgttgctgttcggaatgccattgataaatcagtgggtgatagagaatcaagcattaagcaattttgtgtgcatttgggtagtgatcttgaagaattaaacaacgaagtgaatgaagtaaaactgcaagcacaggatccacagattttagatatctctgctgaccaagacaaaataaggctcatattgaataatctgcaatctgttctggctgatcttcagaaacgtgcatttcagtataagtcctatcagaagaattttaaggtagaagtgtccaagtttgaagctttggaagaagtcagtgctgaactgaagctcaaacaattgctctgggattctttctctgaatgggataaactccaacaagaatggttaaagtccaaatttgattgcctggatccagaagtcctaaacggtcaagtttctaaatatgctaaatttgtgactcaactggaaaaaggcttgccacccaacagtgtagtgccccagctcaaatacaaggtggaaaaaatgaaagaaaagcttccagttatcattgacttgaggaacccgactttgaaggcaagacattgggcagctattgaacaaacagttgatgccactctagtggatgctgaaattccattaaccttggagaggctctcccagttgcatgtttttgactttggtcaagaaatccaggacatatctggacaggcttctggagaagctgccttagaagcaattcttaaaaaggtggaggactcttggaaaacaactgaatttgtcattctgcctcaccgtgactccaaagatgtgtttatactgggcggcacagatgacatacaggtccttcttgatgatagcaccatcaatgttgcaactcttgcctcatcacgttaccttggtccactgaaaactcgagtggatgaatggcaaaaacaacttgctttatttaatcaaacactggaagagtggctgacctgccagagaaactggctctacctagaaagtattttcaatgctccagacattcagaggcaattgcctgcagaggccaagatgttccttcaggtggataagtcatggaaagaaatcatgagaaaggtgaatcggctgcctaatgctcttcgagccgctactcagccaggacttctggaaacttttcaaaacaataatgcattacttgaccaaattcagaagtgcctagaggcatacttagaatcaaaaagagttatctttccaaggttttacttcttgtcaaatgatgaacttctggagattttggcccagacacgaaatccacaggccgtgcagccacacttaaggaaatgcttcgactccatttcaaagctcgaatttgctctcatgcctcctgccgaaggaaagattcctggtattgatggagaaccagaaaaggtttatactaatgatattttagcaatgctgtcaccagagggagaaagggttagcttggggaaaggcctcaaggcccgaggcaatgtagaggaatggcttggtaaagtggaagaagccatgttcacatctctgcgtcgcctgtgcaaagctgccatcgctgactatcaggggaaactgaggacagactgggtggttgctggccacccttctcaagttatcctgactgtttctcaaattatgtggtgccgtgatttgactgaatgtctggaaacagaacacagtaatcatatacaggccctgaagaattttgaaaaagtaaattttgagagattaaatgccctagctgcaatagttcaaggcagtcttcctaaattacacagaaacatcctaactgcattgattactattgatgtgcatgcaagagatatagtcactgaacttgttcaatccaaggtggagacagttgaatcttttgactggcagagacaactgcgctattactgggatatagacctggataattgtgtggctagaatggcgctctctcagtacacttatggctatgaatatttgggtgcatgcccaagattggttattactccactcacagatcgctgctatctttgcctcatgggagctttgcagcttgaccttgggggtgcaccagctggtcctgctggcactgggaaaacagagactaccaaagatctggcaaaagctcttgccatccagtgtgtggtctttaactgttcagatggtttggactacaagatgatggggcgcttcttcagtggcttggcacagtcaggggcctggtgctgctttgatgaatttaatcgaattgacatagaagttctgtccgtcatcgcgcagcaactcattaccattaggaacgccaaagcggcaaagctctctagattcatgtttgaggggcgggaaataaagttggtgatgacttgtgcagccttcatcacaatgaatcctggctatgcagggagaactgaattgccagataatttgaaagccctgtttagaccatttgcgatgatggttccaaattatgccttgattgcagaggtaattctatattctgaaggatttgaatccagtaaaatattagcaagaaaaatgactcagatgtataagctttgcagtgagcagctgtctcagcaggatcactacgactttggcatgagagctgtgaagtctgtcctggtcatggctggatctttaaaaagagaaaacccagacctaaatgaagatgtggtgttgataagagctttacaagactccaatttgccaaaatttctaacagatgatgctcttctgttcagtggaatcatatctgacctttttcctggagtccaaattccagaacatgattatggtattttacaatcaacaattgtggatgtcatgaatagacaaaatcttcagcctgagatgtgtatggttagaaaggtgatacagttttatgaaactatgctagtaaggcatggtgttatgttagtcgggccaacaggaggcggcaagaccacagtttaccgaatactagcagaaactttagggaatttacaaaaacttgggatagaaaattccttttaccaagcagttaaaacatatgttctcaaccctaaatcaattaccatgggtgaattatatggagaggttaataacttaaccttggaatggaaagatggtttgatggcactaagtgtccgagcagctgtgaatgatacttcagaagaccataaatggatcatcagtgatgggccagtagatgctctttggattgaaaacatgaatacagtgctggatgataacaagatgctttgcctggctaacagtgagaggattaaactcacacctcaaattcacatgctttttgaggtgcaagatctgcgggttgcctcccctgcaacagtcagtcgatgtggaatggtgtttgtggatcctgaagaactgaaatggatgccttatgttaaaacttggatgaagggtatttctaaaaaactgactgaggaaacccaagaatatatattgaatcttttccaacgttatgttgatgaaggtttacattttatcaataaaaagtgcagccaagcaattccacaagtggacatcagcaaagttactacactctgttgcttattggagtccttgatacttgggaaagatggagttaacttggcaatggaacaaacaaaattgaacactatactatgtcagacttttgtattctgttatttgtggtctttgggtggaaacctaactgaaaactactatgattcttttgatacatttattagaacacaatttgatgataatcctgatgccaggcttcccaattctggtgatctgtggagcattcatatggactttgacaccaaacggctggatccctgggaacgaatcatacctactttcaaatacaaccgagatgttccattttttgaaatgcttgtccccacaactgacacagtgcgctatgggtatctaatggaaaaactactggcagtcaagcattccgtgttgtttactggaataactggagtgggcaagtctgtgattgcaaaaggattgctaaataaaattcaagaatcagctggctatgtccctgtttatctaaatttttctgctcaaacttcatctgcaaggacacaagagatcattgagtcaaaactggagagaaaaagaaaaaatattctaggagcaccgggaaacaaacgaattgtgatttttgttgatgatttaaacatgcccagactggatcgctatggctctcagcctccgattgaattacttcggcagtatcaagattttgggggattttatgacagaaacaaactgttttggaaagaaatacaggatgtaacaatcatatcggcatgtgcacctccaggcggtggccgcaaccctgtgactccccgcttcatcagacacttcagcatgctgtgcctcccaatgccctcagagcacagtctgaaacagatttttcaggccatcttaaatggtttcctgagtgactttccaccagctgtaaagcaaactgcatcaagcattgtagaagcctcagttgagatttataacaaaatgagtgttgacctcctgccaacacccgccaagtcccattatgtctttaacttgagggacttatccaaatgtgtgcaaggtatcctccaatgtgatccaggaacaataagagaagaaattcagatatttagactcttttgccatgagtgccaaagggtcttccatgatcgcttgattaataatgaagataagcactatttccatgttattctgacagaaatggccaacaaacattttggaattgcaattgacctggaatattttttgaataagcccatcatatttggagatttcattaagtttggagcagataaagctgatcggatttatgatgacatgcctgatatagagaaaactgcaaatgttctacaggactatcttgatgattataatctcacaaatcccaaagaagtaaagttggtgttcttccaggatgctatagaacatgtttcaaggattgctcggatgatacgtcaagaaagaggcaatgccctgcttgttggagtaggaggcacaggaaagcagtcactcacgagacttgcagctcatatatgcggttacaaatgtttgcagattgaactcagccggggatataattatgatagttttcatgaagacctgaggaagttgtacaaaatggctggtgtagaagacaagaatatggttttccttttcactgacacccagattgtagtggaggagttcctagaagatataaataacatcctgaactcaggtgaagtgcctaatttatttgaaaaggatgaactggagcaggttttagcggccaccagaccaagagcaaaagaagtaggaatttctgaggggaacagagacgaggtgtttcaatactttatcagcaaagtgcgtcagaagctgcacattgttctctgcatgagcccagttggggaggcctttcggtcccgatgcaggatgtttccatcccttgtgaattgctgcaccattgactggtttgtgcagtggcccagagaagcacttctttctgtgtcaaagacatttttctcacaagtcgatgctggaaatgaagaactgaaagaaaagcttcccttgatgtgcgtgaacgttcacttgagtgtctccagcatggcagagcgctattacaatgagctgcgcaggcggtactacacgacacccacctcctacctggagcttatcaatctttacctgtctatgctgtctgaaaaaaggaagcagattatttcagcacgagatcgggtgaagaatggtctcaccaagctactagaaacaaacatactagtagataaaatgaaactagatctttcagctttagagcctgtacttttagcaaaatcagaagatgttgaagccctgatggaaaaattggcagtggatcaagaaagtgccgatcaggtccgtaacactgtgcaggaggatgaagcaacagcaaaagtcaaagctgaagaaacccaagcaatagctgatgatgctcaaagagatcttgacgaggcactacctgcactagatgctgccaataaagcactggattccttagataaggcagatatatctgaaatcagagtttttacaaagcccccagatttggtcatgacagtaatggaagcaatctccattcttttgaatgccaagcctgattggccatcagcaaagcaacttcttggtgactctaactttctaaaaaggcttttagaatatgataaggagaacataaagcctcagatattggcaaagcttcaaaagtatattaataatcctgattttgtgcctgaaaaagtggagaaagtgtccaaagcatgtaaatctatgtgcatgtgggtaagagctatggatttgtactctcgagtggtcaaggtcgtcgaaccaaaaagacaaaagctccgcgccgcacaggctgaacttgacattaccatggctaccctgagagaaaagcaagcattactaagacaagtagaagatcaaatacaggccttacaagatgaatatgacaaaggtgtaaatgaaaaagaaagcctggcaaagaccatggccctgacaaaagcacgtctagtacgtgctggaaagctgacagcagcattagaagatgagcaggttcgatgggaagaaagcatacagaagtttgaggaagaaatatcaaatatcactgggaacgtgttcatagcagcagcttgtgtggcctactatggggctttcacagcccagtacaggcagtcacttatagagtgttggatccaggactgtcagtctctggagatcccaatcgatccttccttcagtctcattaacattcttggagatccctacgagatacggcagtggaacactgatgggctgccccgtgacttgatatcaacagaaaatggcattttggttactcaaggcagaagatggcctttgatgattgatccccaagatcaggcaaaccgttggataaggaacaaggaaagcaaaagtggtttaaagatcattaagcttacagatagtaatttcttacgaatactcgagaattcaatccgacttggtttacctgtcttactggaagagcttaaggaaaccttggatccagctctagaacccattcttttgaaacaaatttttatcagtggtggccgactactcatccgtcttggagactcagacattgattatgacaaaaactttaggttctatatgacaaccaaaatgccaaatccccactatctgcctgaggtatgcattaaagttaccattatcaatttcactgtaacaaaatcaggcctggaggatcagttgttaagtgatgtggtgcgacttgaaaaacccaggttggaagaacaaagaattaagctcatcgtgaggatcaacactgataaaaaccagttgaaaactatcgaagagaaaatcctgagaatgctctttacctctgaaggaaatattctggacaatgaagaacttattgacacactccaggattcaaagatcacttctggtgccattaaaaccaggctggaagaagcagagtccactgagcagatgatcaatgtggctcgtgagaagtatcgtccagtggccactcaaggctctgtaatgtactttgtcattgcaagcctctcagaaatagatcctatgtaccagtactcattaaaatactttaaacagttgttcaataccaccattgaaacttctgtaaagacagaaaatctacaacagcgcctggacgtactactagaacaaactctcctaactgcttatgtcaatgtttcaagaggactttttgagcaacataaactcatctacagctttatgctttgtgttgagatgatgcgtcagcaaggaaccctatctgatgctgaatggaatttctttctccgaggttctgcaggattggaaaaggaacgcccacctaagcctgaagctccctggctacctactgctacatggttcgcatgctgtgacttggaagaatcatttccagtttttcacggacttacccaaaatatattgtcacatcctatttccatacgcttaggatcttttgagacttatattaacccacagaaatgggaaggctattctaaaatgaaacacgaagataaacacatgagacaggaaaaggaggcagcacaccaagatccatggagtgcaggattgagttctttccataagctaattcttattaaatgttgtaaagaagaaaaggtggtttttgctcttacagactttgtgatagaaaatcttggaaaacagtttatagagacaccacctgtggacctgcctaccctgtatcaagacatgtcatgcaacactcccctggtattcatcctaagcacaggctcagatcccatgggtgcatttcagaggtttgccagggaaagtggatattcagaacgggtgcagtcaatttcactggggcaaggacaaggacctattgctgaaaaaatggtcaaggatgcaatgaaatcaggaaactgggtatttttgcaaaattgccatcttgctgtttcttggatgttggcaatggaagagctcattaaaaccttcacagatccagatagtgctatcaaggacacttttcgactttttttaagctccatgcctagtaatacatttcctgttacagttcttcaaaattctgtcaaggtgaccaatgagcctccaaaaggcttacgtgcaaatatcagacgagcatttactgaaatgacaccttcgttttttgaagaaaatatacttggaaaaaaatggagacaaataatatttggcatttgtttcttccatgcaattattcaggagagaaagaagtttggcccccttggttggaatatctgctatgaatttaatgacagtgacagggaatgtgctttactgaatctcaaactctattgtaaagaaggaaagattccctgggatgcactaatttacattactggtgaaattacttatggtggtagagtcacagacagctgggaccaaagatgccttcgtactatcttgaaaagatttttttctcctgaaacattagaagaagattataaatactctgaatcaggcatctattttgcacccatggctgacagcctacaagagtttaaggactacattgaaaatctgcctttgatcgatgacccagaaatttttggaatgcatgaaaatgctaatctagtcttccagtacaaagagaccagcactttaatcaacaccatacttgaggttcagccaaggtcatctactggtggagagggaaaaagcaatgacgaaattgttcaagaacttgttgcttctgtccagaccagagttccagaaaaactggaaatggagggtgcttctgagagcctttttgtcaaggatcttcaaggacgtctgaactccttgaccaccgttcttggacaggaagtggaccggtttaacaacctgctgaagttaattcatacttctctggaaacactcaacaaagccatcgctggatttgtggtgatgtctgaagaaatggaaaaagtgtataacagtttcctcaacaaccaggttcccgctctgtggtccaacacagcctacccatccctgaagccactaggatcatgggtcaaagaccttatcctgaggacctcatttgtggatctgtggctcaaaagaggacagcctaagtcctactggatctctggtttcttctttcctcaaggatttctaacaggaactcttcaaaatcatgctcgaaaatacaatttgcctatagatgagctgagtttcaaatacagcgtaattcccacctatcgggatcaagctgcagtgatagaagctgccaagacagtgcaatttggacaagaactgcccatggacatggagttgccctctcctgaggatggtgttcttgttcatgggatgttcatggatgcttctcgatgggatgataaggagatggtgatagaagatgcattgcccggacagatgaatccagtgctgcctgtggtgcattttgaaccacaacaaaactataagccaagcccaacactttaccactgcccactttataaaacaggagcccgggcaggaacactctcaaccacaggacattcaaccaattttgtggtaaccgtcctgttaccctccaagcggtccaaagactactggattgccaagggatcagctttgctctgccagctgagcgaatgaaaaggtgccacctcagccctgaaaaagaaccaggccagagatctttcctaatgggagcaaaaggtttgaataatttatatgtgagcaaaacggtgttaattctgatttgacttaaacgtattgtgacttttatttctcttatgaccttaaaataaagtgtttgagttctttctgttggcaa

SEQ ID NO: 128536 - DNA, 12795 bp, Homo sapiens
  Payload ID: 5159
  Gene Symbol: DNAH6
  Gene Name: dynein, axonemal, heavy chain 6
  Uniprot ID: Q9C0G6
  ENST ID: ENST00000389394
  CDS Start-End: 138-12614
gcttccgtagaggccagctggttgctacgcagcaacaggaaacattccgcgctaccgagtactttctactcccgaccaggcattgctctctctggagaccctcggcggtggttgctgtattttgacttggagtaaggatgacttttcgggccacagatagtgaatttgacctgacaaatattgaagagtatgccgaaaattctgcactttcaagactgaataatataaaagccaaacaaagagtgagttatgtgacatccacagaaaatgaatctgatacacaaatcctaacgtttaggcacattacaaaagctcaggagaagacaagaaaacgacagcagcctataaaactagagcctttgccagtgctaaaagtctaccaagatcataagcagccagaatacatacatgaacagaaccgatttcagttaatgactgcaggaatcattaaacgtccagtaagcatagcaaaaaaaagttttgccacatcatctactcagtttcttgagcatcaagatgctgtgaaaaaaatgcagattcatcggccctatgttgaggtgttctctccctctcctcctaaactgccacatactggtattggaaaaagaggtctctttgggactagatcttcagcttaccctaagtacacttttcacgaccgagaagaagttgttaaagccaacattcgtgatcccttgcaaatcattaaaataatacgtgaaaatgaacatcttggatttctttatatgatccctgcagtgccaagatcatccattgaatatgatacatataatctaaaagttgtaagttatgagaacatcaataaaaatgactactatactattagccaaagggcagtaacacacatttataatgaagacattgaatttatcgaaattgatcgatgggaacaggaatatctgtatcacagagaactcactaagattcccatattttcactgttccggaaatggaaggcttttagtgtatggaggaagaatgtccgctccaagaaaatcactggatgtcaaaaatctctacaaaaaaatttgttcattgttaatcctcatttgcgaccagctcttcttaaaataaatgaattgtgttatcatttgagttttatgggactttgttatattgaaaagtgtcacacctacaccctgcaggaatttaaggccgcacaagtcatacggctagcagaggtgacagaacgcctaggagaatttcgaaatgaggcaaaatatgtagtcaggagggcttgtcgatttgctttgcgtgctgcaggatttgttcctgatgactgtgcatttggaccttttgaggattatcataaagtgcagagcagtggaagtttcattaatacaccacatgagttgcccacttatggagactctgagaaaatgacatatacagaacaggccagcaaaaggcattattgcatgaggctgacgtgctttattcgtctaaacgactatctaattgagaacacaatgcacatcttaacggtaaatgctgttaattcgcttttgaaccatctcactgacaagctaaaacgaacaccttcagcagatgtcattcagaaatggattactgaagagaagcctgaagtccctgataaaaaggggacccttatggtggaaaagcaagaagaagatgaatctctcatccccatgtttctcacagaactaatgttgacagtccagtcactgctctttgagccttctctggaagactttctggatggtattttgggtgcagttaatcactgtcaaaacactgtgttatcagttcctaatctcgtgcctgattcgtattttgatgctttcaccagcccttatattaacaacaaacttgaaggaaaaacctgtggaactgggccaagtttagcagcagtatttgaggatgataagaattttcacacaattatttctcaaataaaggaaaccattcaggccgcatttgaatcagcccgcatctatgcagctacctttgaaaagttccagatattcttcaaggaaaatgaaagtcttgatttacaagctcttaaacttcaggaacctgatattaacttttttagtgaacaactggaaaaatatcacaaacagcacaaggacgcagtagcgctcagacccaccagaaatgtaggattgctgctcattgatactaggcttctaagagaaaaattaattccatcacctttgcgatgcttagaggtgctaaattttatgcttcctcgtcaaagcaagaaaaaagtggatgccattatctttgaggcacaagatgcagagtataaacttgagtttgttccaactactaccacagaatatgttcatagcttattatttcttgatgaaattcaggaacggattgaaagccttgaagatgaggggaatatagtgactcaaatgtacaagcttatggaacaatatcaggtgcccacacctcctgaagactttgctgtttttgcaactatgaagccatccattgttgctgttcggaatgccattgataaatcagtgggtgatagagaatcaagcattaagcaattttgtgtgcatttgggtagtgatcttgaagaattaaacaacgaagtgaatgaagtaaaactgcaagcacaggatccacagattttagatatctctgctgaccaagacaaaataaggctcatattgaataatctgcaatctgttctggctgatcttcagaaacgtgcatttcagtataagtcctatcagaagaattttaaggtagaagtgtccaagtttgaagctttggaagaagtcagtgctgaactgaagctcaaacaattgctctgggattctttctctgaatgggataaactccaacaagaatggttaaagtccaaatttgattgcctggatccagaagtcctaaacggtcaagtttctaaatatgctaaatttgtgactcaactggaaaaaggcttgccacccaacagtgtagtgccccagctcaaatacaaggtggaaaaaatgaaagaaaagcttccagttatcattgacttgaggaacccgactttgaaggcaagacattgggcagctattgaacaaacagttgatgccactctagtggatgctgaaattccattaaccttggagaggctctcccagttgcatgtttttgactttggtcaagaaatccaggacatatctggacaggcttctggagaagctgccttagaagcaattcttaaaaaggtggaggactcttggaaaacaactgaatttgtcattctgcctcaccgtgactccaaagatgtgtttatactgggcggcacagatgacatacaggtccttcttgatgatagcaccatcaatgttgcaactcttgcctcatcacgttaccttggtccactgaaaactcgagtggatgaatggcaaaaacaacttgctttatttaatcaaacactggaagagtggctgacctgccagagaaactggctctacctagaaagtattttcaatgctccagacattcagaggcaattgcctgcagaggccaagatgttccttcaggtggataagtcatggaaagaaatcatgagaaaggtgaatcggctgcctaatgctcttcgagccgctactcagccaggacttctggaaacttttcaaaacaataatgcattacttgaccaaattcagaagtgcctagaggcatacttagaatcaaaaagagttatctttccaaggttttacttcttgtcaaatgatgaacttctggagattttggcccagacacgaaatccacaggccgtgcagccacacttaaggaaatgcttcgactccatttcaaagctcgaatttgctctcatgcctcctgccgaaggaaagattcctggtattgatggagaaccagaaaaggtttatactaatgatattttagcaatgctgtcaccagagggagaaagggttagcttggggaaaggcctcaaggcccgaggcaatgtagaggaatggcttggtaaagtggaagaagccatgttcacatctctgcgtcgcctgtgcaaagctgccatcgctgactatcaggggaaactgaggacagactgggtggttgctggccacccttctcaagttatcctgactgtttctcaaattatgtggtgccgtgatttgactgaatgtctggaaacagaacacagtaatcatatacaggccctgaagaattttgaaaaagtaaattttgagagattaaatgccctagctgcaatagttcaaggcagtcttcctaaattacacagaaacatcctaactgcattgattactattgatgtgcatgcaagagatatagtcactgaacttgttcaatccaaggtggagacagttgaatcttttgactggcagagacaactgcgctattactgggatatagacctggataattgtgtggctagaatggcgctctctcagtacacttatggctatgaatatttgggtgcatgcccaagattggttattactccactcacagatcgctgctatctttgcctcatgggagctttgcagcttgaccttgggggtgcaccagctggtcctgctggcactgggaaaacagagactaccaaagatctggcaaaagctcttgccatccagtgtgtggtctttaactgttcagatggtttggactacaagatgatggggcgcttcttcagtggcttggcacagtcaggggcctggtgctgctttgatgaatttaatcgaattgacatagaagttctgtccgtcatcgcgcagcaactcattaccattaggaacgccaaagcggcaaagctctctagattcatgtttgaggggcgggaaataaagttggtgatgacttgtgcagccttcatcacaatgaatcctggctatgcagggagaactgaattgccagataatttgaaagccctgtttagaccatttgcgatgatggttccaaattatgccttgattgcagaggtaattctatattctgaaggatttgaatccagtaaaatattagcaagaaaaatgactcagatgtataagctttgcagtgagcagctgtctcagcaggatcactacgactttggcatgagagctgtgaagtctgtcctggtcatggctggatctttaaaaagagaaaacccagacctaaatgaagatgtggtgttgataagagctttacaagactccaatttgccaaaatttctaacagatgatgctcttctgttcagtggaatcatatctgacctttttcctggagtccaaattccagaacatgattatggtattttacaatcaacaattgtggatgtcatgaatagacaaaatcttcagcctgagatgtgtatggttagaaaggtgatacagttttatgaaactatgctagtaaggcatggtgttatgttagtcgggccaacaggaggcggcaagaccacagtttaccgaatactagcagaaactttagggaatttacaaaaacttgggatagaaaattccttttaccaagcagttaaaacatatgttctcaaccctaaatcaattaccatgggtgaattatatggagaggttaataacttaaccttggaatggaaagatggtttgatggcactaagtgtccgagcagctgtgaatgatacttcagaagaccataaatggatcatcagtgatgggccagtagatgctctttggattgaaaacatgaatacagtgctggatgataacaagatgctttgcctggctaacagtgagaggattaaactcacacctcaaattcacatgctttttgaggtgcaagatctgcgggttgcctcccctgcaacagtcagtcgatgtggaatggtgtttgtggatcctgaagaactgaaatggatgccttatgttaaaacttggatgaagggtatttctaaaaaactgactgaggaaacccaagaatatatattgaatcttttccaacgttatgttgatgaaggtttacattttatcaataaaaagtgcagccaagcaattccacaagtggacatcagcaaagttactacactctgttgcttattggagtccttgatacttgggaaagatggagttaacttggcaatggaacaaacaaaattgaacactatactatgtcagacttttgtattctgttatttgtggtctttgggtggaaacctaactgaaaactactatgattcttttgatacatttattagaacacaatttgatgataatcctgatgccaggcttcccaattctggtgatctgtggagcattcatatggactttgacaccaaacggctggatccctgggaacgaatcatacctactttcaaatacaaccgagatgttccattttttgaaatgcttgtccccacaactgacacagtgcgctatgggtatctaatggaaaaactactggcagtcaagcattccgtgttgtttactggaataactggagtgggcaagtctgtgattgcaaaaggattgctaaataaaattcaagaatcagctggctatgtccctgtttatctaaatttttctgctcaaacttcatctgcaaggacacaagagatcattgagtcaaaactggagagaaaaagaaaaaatattctaggagcaccgggaaacaaacgaattgtgatttttgttgatgatttaaacatgcccagactggatcgctatggctctcagcctccgattgaattacttcggcagtatcaagattttgggggattttatgacagaaacaaactgttttggaaagaaatacaggatgtaacaatcatatcggcatgtgcacctccaggcggtggccgcaaccctgtgactccccgcttcatcagacacttcagcatgctgtgcctcccaatgccctcagagcacagtctgaaacagatttttcaggccatcttaaatggtttcctgagtgactttccaccagctgtaaagcaaactgcatcaagcattgtagaagcctcagttgagatttataacaaaatgagtgttgacctcctgccaacacccgccaagtcccattatgtctttaacttgagggacttatccaaatgtgtgcaaggtatcctccaatgtgatccaggaacaataagagaagaaattcagatatttagactcttttgccatgagtgccaaagggtcttccatgatcgcttgattaataatgaagataagcactatttccatgttattctgacagaaatggccaacaaacattttggaattgcaattgacctggaatattttttgaataagcccatcatatttggagatttcattaagtttggagcagataaagctgatcggatttatgatgacatgcctgatatagagaaaactgcaaatgttctacaggactatcttgatgattataatctcacaaatcccaaagaagtaaagttggtgttcttccaggatgctatagaacatgtttcaaggattgctcggatgatacgtcaagaaagaggcaatgccctgcttgttggagtaggaggcacaggaaagcagtcactcacgagacttgcagctcatatatgcggttacaaatgtttgcagattgaactcagccggggatataattatgatagttttcatgaagacctgaggaagttgtacaaaatggctggtgtagaagacaagaatatggttttccttttcactgacacccagattgtagtggaggagttcctagaagatataaataacatcctgaactcaggtgaagtgcctaatttatttgaaaaggatgaactggagcaggttttagcggccaccagaccaagagcaaaagaagtaggaatttctgaggggaacagagacgaggtgtttcaatactttatcagcaaagtgcgtcagaagctgcacattgttctctgcatgagcccagttggggaggcctttcggtcccgatgcaggatgtttccatcccttgtgaattgctgcaccattgactggtttgtgcagtggcccagagaagcacttctttctgtgtcaaagacatttttctcacaagtcgatgctggaaatgaagaactgaaagaaaagcttcccttgatgtgcgtgaacgttcacttgagtgtctccagcatggcagagcgctattacaatgagctgcgcaggcggtactacacgacacccacctcctacctggagcttatcaatctttacctgtctatgctgtctgaaaaaaggaagcagattatttcagcacgagatcgggtgaagaatggtctcaccaagctactagaaacaaacatactagtagataaaatgaaactagatctttcagctttagagcctgtacttttagcaaaatcagaagatgttgaagccctgatggaaaaattggcagtggatcaagaaagtgccgatcaggtccgtaacactgtgcaggaggatgaagcaacagcaaaagtcaaagctgaagaaacccaagcaatagctgatgatgctcaaagagatcttgacgaggcactacctgcactagatgctgccaataaagcactggattccttagataaggcagatatatctgaaatcagagtttttacaaagcccccagatttggtcatgacagtaatggaagcaatctccattcttttgaatgccaagcctgattggccatcagcaaagcaacttcttggtgactctaactttctaaaaaggcttttagaatatgataaggagaacataaagcctcagatattggcaaagcttcaaaagtatattaataatcctgattttgtgcctgaaaaagtggagaaagtgtccaaagcatgtaaatctatgtgcatgtgggtaagagctatggatttgtactctcgagtggtcaaggtcgtcgaaccaaaaagacaaaagctccgcgccgcacaggctgaacttgacattaccatggctaccctgagagaaaagcaagcattactaagacaagtagaagatcaaatacaggccttacaagatgaatatgacaaaggtgtaaatgaaaaagaaagcctggcaaagaccatggccctgacaaaagcacgtctagtacgtgctggaaagctgacagcagcattagaagatgagcaggttcgatgggaagaaagcatacagaagtttgaggaagaaatatcaaatatcactgggaacgtgttcatagcagcagcttgtgtggcctactatggggctttcacagcccagtacaggcagtcacttatagagtgttggatccaggactgtcagtctctggagatcccaatcgatccttccttcagtctcattaacattcttggagatccctacgagatacggcagtggaacactgatgggctgccccgtgacttgatatcaacagaaaatggcattttggttactcaaggcagaagatggcctttgatgattgatccccaagatcaggcaaaccgttggataaggaacaaggaaagcaaaagtggtttaaagatcattaagcttacagatagtaatttcttacgaatactcgagaattcaatccgacttggtttacctgtcttactggaagagcttaaggaaaccttggatccagctctagaacccattcttttgaaacaaatttttatcagtggtggccgactactcatccgtcttggagactcagacattgattatgacaaaaactttaggttctatatgacaaccaaaatgccaaatccccactatctgcctgaggtatgcattaaagttaccattatcaatttcactgtaacaaaatcaggcctggaggatcagttgttaagtgatgtggtgcgacttgaaaaacccaggttggaagaacaaagaattaagctcatcgtgaggatcaacactgataaaaaccagttgaaaactatcgaagagaaaatcctgagaatgctctttacctctgaaggaaatattctggacaatgaagaacttattgacacactccaggattcaaagatcacttctggtgccattaaaaccaggctggaagaagcagagtccactgagcagatgatcaatgtggctcgtgagaagtatcgtccagtggccactcaaggctctgtaatgtactttgtcattgcaagcctctcagaaatagatcctatgtaccagtactcattaaaatactttaaacagttgttcaataccaccattgaaacttctgtaaagacagaaaatctacaacagcgcctggacgtactactagaacaaactctcctaactgcttatgtcaatgtttcaagaggactttttgagcaacataaactcatctacagctttatgctttgtgttgagatgatgcgtcagcaaggaaccctatctgatgctgaatggaatttctttctccgaggttctgcaggattggaaaaggaacgcccacctaagcctgaagctccctggctacctactgctacatggttcgcatgctgtgacttggaagaatcatttccagtttttcacggacttacccaaaatatattgtcacatcctatttccatacgcttaggatcttttgagacttatattaacccacagaaatgggaaggctattctaaaatgaaacacgaagataaacacatgagacaggaaaaggaggcagcacaccaagatccatggagtgcaggattgagttctttccataagctaattcttattaaatgttgtaaagaagaaaaggtggtttttgctcttacagactttgtgatagaaaatcttggaaaacagtttatagagacaccacctgtggacctgcctaccctgtatcaagacatgtcatgcaacactcccctggtattcatcctaagcacaggctcagatcccatgggtgcatttcagaggtttgccagggaaagtggatattcagaacgggtgcagtcaatttcactggggcaaggacaaggacctattgctgaaaaaatggtcaaggatgcaatgaaatcaggaaactgggtatttttgcaaaattgccatcttgctgtttcttggatgttggcaatggaagagctcattaaaaccttcacagatccagatagtgctatcaaggacacttttcgactttttttaagctccatgcctagtaatacatttcctgttacagttcttcaaaattctgtcaaggtgaccaatgagcctccaaaaggcttacgtgcaaatatcagacgagcatttactgaaatgacaccttcgttttttgaagaaaatatacttggaaaaaaatggagacaaataatatttggcatttgtttcttccatgcaattattcaggagagaaagaagtttggcccccttggttggaatatctgctatgaatttaatgacagtgacagggaatgtgctttactgaatctcaaactctattgtaaagaaggaaagattccctgggatgcactaatttacattactggtgaaattacttatggtggtagagtcacagacagctgggaccaaagatgccttcgtactatcttgaaaagatttttttctcctgaaacattagaagaagattataaatactctgaatcaggcatctattttgcacccatggctgacagcctacaagagtttaaggactacattgaaaatctgcctttgatcgatgacccagaaatttttggaatgcatgaaaatgctaatctagtcttccagtacaaagagaccagcactttaatcaacaccatacttgaggttcagccaaggtcatctactggtggagagggaaaaagcaatgacgaaattgttcaagaacttgttgcttctgtccagaccagagttccagaaaaactggaaatggagggtgcttctgagagcctttttgtcaaggatcttcaaggacgtctgaactccttgaccaccgttcttggacaggaagtggaccggtttaacaacctgctgaagttaattcatacttctctggaaacactcaacaaagccatcgctggatttgtggtgatgtctgaagaaatggaaaaagtgtataacagtttcctcaacaaccaggttcccgctctgtggtccaacacagcctacccatccctgaagccactaggatcatgggtcaaagaccttatcctgaggacctcatttgtggatctgtggctcaaaagaggacagcctaagtcctactggatctctggtttcttctttcctcaaggatttctaacaggaactcttcaaaatcatgctcgaaaatacaatttgcctatagatgagctgagtttcaaatacagcgtaattcccacctatcgggatcaagctgcagtgatagaagctgccaagacagtgcaatttggacaagaactgcccatggacatggagttgccctctcctgaggatggtgttcttgttcatgggatgttcatggatgcttctcgatgggatgataaggagatggtgatagaagatgcattgcccggacagatgaatccagtgctgcctgtggtgcattttgaaccacaacaaaactataagccaagcccaacactttaccactgcccactttataaaacaggagcccgggcaggaacactctcaaccacaggacattcaaccaattttgtggtaaccgtcctgttaccctccaagcggtccaaagactactggattgccaagggatcagctttgctctgccagctgagcgaatgaaaaggtgccacctcagccctgaaaaagaaccaggccagagatctttcctaatgggagcaaaaggtttgaataatttatatgtgagcaaaacggtgttaattctgatttgacttaaacgtattgtgacttttatttctcttatgaccttaaaataaagtgtttgagttctttctgttggcaa

SEQ ID NO: 128537 - DNA, 1873 bp, Homo sapiens
  Payload ID: 5159
  Gene Symbol: DNAH6
  Gene Name: dynein, axonemal, heavy chain 6
  ENST ID: ENST00000602588
  CDS Start-End: 166-1821
caagaatatatattgaatcttttccaacgttatgttgatgaaggtttacattttatcaataaaaagtgcagccaagcaattccacaagtggacatcagcaaagttactacactctgttgcttattggagtccttgatacttgggaaagatggagttaacttggcaatggaacaaacaaaattgaacactatactatgtcagacttttgtattctgttatttgtggtctttgggtggaaacctaactgaaaactactatgattcttttgatacatttattagaacacaatttgatgataatcctgatgccaggcttcccaattctggtgatctgtggagcattcatatggactttgacaccaaacggctggatccctgggaacgaatcatacctactttcaaatacaaccgagatgttccattttttgaaatgcttgtccccacaactgacacagtgcgctatgggtatctaatggaaaaactactggcagtcaagcattccgtgttgtttactggaataactggagtgggcaagtctgtgattgcaaaaggattgctaaataaaattcaagaatcagctggctatgtccctgtttatctaaatttttctgctcaaacttcatctgcaaggacacaagagatcattgagtcaaaactggagagaaaaagaaaaaatattctaggagcaccgggaaacaaacgaattgtgatttttgttgatgatttaaacatgcccagactggatcgctatggctctcagcctccgattgaattacttcggcagtatcaagattttgggggattttatgacagaaacaaactgttttggaaagaaatacaggatgtaacaatcatatcggcatgtgcacctccaggcggtggccgcaaccctgtgactccccgcttcatcagacacttcagcatgctgtgcctcccaatgccctcagagcacagtctgaaacagatttttcaggccatcttaaatggtttcctgagtgactttccaccagctgtaaagcaaactgcatcaagcattgtagaagcctcagttgagatttataacaaaatgagtgttgacctcctgccaacacccgccaagtcccattatgtctttaacttgagggacttatccaaatgtgtgcaagacaaacattttggaattgcaattgacctggaatattttttgaataagcccatcatatttggagatttcattaagtttggagcagataaagctgatcggatttatgatgacatgcctgatatagagaaaactgcaaatgttctacaggactatcttgatgattataatctcacaaatcccaaagaagtaaagttggtgttcttccaggatgctatagaacatgtttcaaggattgctcggatgatacgtcaagaaagaggcaatgccctgcttgttggagtaggaggcacaggaaagcagtcactcacgagacttgcagctcatatatgcggttacaaatgtttgcagattgaactcagccggggatataattatgatagttttcatgaagacctgaggaagttgtacaaaatggctggtgtagaagacaagaatatggttttccttttcactgacacccagattgtagtggaggagttcctagaagatataaataacatcctgaactcaggtgaagtgcctaatttatttgaaaaggatgaactggagcaggttttagcggccaccagaccaagagcaaaagaagtaggaatttctgaggggaacagagacgaggtaggatgtgccagagtagttatgtggctttatcacaaaaacgtttcttcaccttttatttaaccattcattgattgcctgaaggggtccatgaataaaatttttttcaatataa

SEQ ID NO: 128538 - DNA, 12394 bp, Homo sapiens
  Payload ID: 5160
  Gene Symbol: DNAH7
  Gene Name: dynein, axonemal, heavy chain 7
  Uniprot ID: Q8WXX0
  ENST ID: ENST00000312428
  CDS Start-End: 102-12176
gagaccgctgcaagtcccggggccctgcctctatcgtcctaggggttccgcgggcaggagcaacccagaagcaccggtgaggccagcgcgtcctcgcagccatgagcagtgagcaggataaatcggccagcaaagaaaaatccaagaaaccagtaagatttctaccacagctgtctatggagaaattagccagcaaagaaaagttcaaggcaccagcaagagctttaccacagctgtctatggtgagtacaaagccccactggcagcaggcagctccatcattccatttgagtgtaaagcaggatgatgagagtccagaaccatttagtgttaaaaatgaacagtcccatgctgaatacatggaacgttttggaaaaaagggcaaattaccccaccaagttgatgatagttatgttggaccatctacttccaaatcaaagggcaaatctccacataaagaacgagaaaactttagaagtactcttgttaatgtcattatgcaacaagatgctgacttagactcagctgtccctgatggaagcacaattccaaaaccgaccgcttctgctatagagaaagacatcttgagatattactattatattcaccatggaattgatacagaccatgtagccccaatggaagattcttggctagaacacgtactggatttagttccacaacatctgaaagtcttcactgacagcatagttacattatctgatgaaatgagagaggattatcttcttagtgtaaggaaatccatagttgattttgttttaaaagatcctcgagagaaaggagatgataagaagacagatgaacttccagcccatcgtgctgaaatggaaattctgccaaaaccttggaggaaatcttttttagctgcaagcagttatattagggatcacttgaatgcaatgaaccccacaatgctggctgtactagatttgtggcacactaattttaaaaaattacgtttagttgatatcaaagaatttcataattgccaggatgcattagagctgtcaagttttcagaacattatcatgagacacatggactctgccaaagagactctacttaaaatgtggtttccagaagtgcagaatatttattaccaaggtaataaaaaaaagcaattgccaactggtgacagcagtgccaaattggaatcttttttcaactgtgctgctgcacttatgactttacagctgcaggacctcactttagtctccatgcaagatttcacggacttaattgcacaacccccagattctgttagagcttttgaacatccaggtttcatcatgaggctgattcttgataatgacaccattaagtttgaacctgagttgagtgactatatagatatctttctaaatgtttatgacgtcatgattaaagctgtcagttttgtgccaagagttgagacaaaattgtattccaagtgggaaagtaagtctaaaccaacaaccttgaagcccataattctgaatgaaattgtagatgctcacaaagaaaagatcaaggaagttattatgaaagagagtgtggcacctactgagcacctcagactctatgacaagtatgactttttaattaccagaaaagctgagcgagatgttgataacttcctcgcagaaaatcatagttatgaaaaaataatagatgaaatttgcaaataccagaaactaatagaggaaatacagtacacatccataaagactattcgtttaggaatgtttgaaatgcactgtgaggaattaatcagagctttggtgaagcgagcagatattatttgtgggaaacttctagctaaaatgttcagagatcatcaggaagtaaatacaagattatgcgatgaatttgagaggatagctgaaaaagctcttagcactcctccaaatacagcagaactaatggaaatgaaggcttacattcagaaagtggaggtaactgatatgattgaactagaacagagattagtggattccaaaaactgcctcgccttcctcatcgagtatgtcaacttttctccagcagacatgaggctaaataatagtgttttccagtggtatggaaggatgggagaaatttttgaagaacacaggaaaatcattaaagagaaaatagaacaatatcaagaaggtctgaagttacggtgtgaacggtttgtggaggaattggagagttatgctaagcaatcagaagaattttattcatttggagatcttcaggatgttcagcggtacctaaaaaaggctcaaatactgaatggaaagttggatttagctgcagataagattgagcagtttaatgctgaagaggaagcatttggttggctaccatctgtatatcctcaacgtaaaaaaatccaagatggcttgaacccttatcttcgtctttatgaaactgctgtcgaatttagcagcaactatagagcatggacagaagggccatatcataaagtgaatccagaccaagtagaagcagatattggaaattactggagaggattatataaactggagaaaacctttcatgattctccatatgcattggcaatgacaaaaaaagtaagatcaaaggtggaagatttcaagcagcacattcctctcattcaagtgatctgtaatcctggtttgcgccccaggcactgggaggccatgtctgccattgttggttaccctttgcagccatcagatgactccacagtctcctcttttttagacatgaatctggaaccatatatagaccgatttgaaggtattagtgaagcagctagcaaagaatattctcttgaaaaggcgatggagaagatgattactgagtgggatgcagtggaatttgtcatccattcttatagagaaactgggacatttattttggcatcagttgatgaaattcagatgttgttggatgaccatattattaaaacacaaactatgcgaggatctcctttcattaagccttatgaaaaacaaatgagagaatgggagggcaagctcctactgcttcaggagattctggatgaatggctcaaagtccaagccacgtggctgtatctggagcccattttcagctctccagacattatgtctcaaatgcctgaggaaggcagacgatttacagctgtggataagacatggagagatataatgagaagtgtcatgcaggataaacatgttctgacagttgtaaccattgacagaatgctggaaaggctgaaaaaatctaatgaacttttggagctcattcttaaaggacttaatgaatatttggaaaagaaacgcctctttttccccagattcttttttttgtccaatgatgaacttcttgagatactatctgagactaaagatcccactagggtgcaacctcacttgaagaaatgttttgaaggaatcgcaaaggtagaatttacggaaactttagacattactcacatgaagagcagcgaaggagaggttgtagaactcatagagattatttcaacagccaaagccagaggtcaagtggagaagtggttggttgaattagagagagttatgattaactccatccacaaggtaactggagatgcaacttttgcctatacaaaatatgaacgaattaactgggtaagggattggcctggacagactgttctctgtgtatcccaaatcttttggacaaaagaagtacaaacagctattccaatggggataaaggctcttgagcaatacttgaaaacatgtaacagacaaattgatgatattgtcactttggtgcgtggcaaattgtccatgcagaatcgcgtaactctgggagcacttgtggtactggatgtccatgctagagatgtcctctcatcacttgtaaaaaaaaatattagcgatgactctgactttgaatggttaagtcagcttaggtactactggcaagaaaatcatttagaaacaaaaatgatcaatgctggtttgcgatatggatatgaatatctgggtaattcccctaggctggttattacaccactcacggatagatgttacagaaccttatttggagcccttcatttgcaccttggaggagcacctgagggtccagctggcactgggaagactgaaactaccaaggatttggcaaaagctgtagccaaacaatgtgttgttttcaactgctctgatgggttggattatttggctttgggaaaattctttaagggactgttatcttgtggagcctgggcttgctttgatgagtttaacagaattgatttggaagtactctctgtggttgctcaacaaatccttactatccaaagaggtattaatgcaggtgctgatatactgatgtttgaaggaactgaactaaaacttgaccccacatgtgctgtctttataacaatgaaccctgggtatgctgggcgatcagaactgccagataacctgaaggctctctttcggacagtagcaatgatggtacctgactatgccatgattgctgaaatagtcctatactcctgtgggtttgtcactgctcgaccactgtctgtaaaaattgtggctacgtatcgcttgtgttcagagcagctgtcatctcaacatcactacgactatggaatgagagccgtgaagtcagttcttactgctgctgggaatctgaagctgaaatatccaaatgaaaatgaagaaattttgctgcttagatctatcattgatgtaaatctgccaaaatttttatcccatgatttaccactctttgagggaattacttcggatttgtttcctggggtaaaattaccaaaaccagattacaatgatttgctggcagctatcaaagacaattgtgcctccatgaatttgcaaatgactgcattcttttccgagaagattcttcaagtatatgaaatgatgattgtgcgtcatggttttatgattgttggagaaccatttggaggaaaaactagtgcatatcgtgtcttagctggagcactaaatgatatatgtgaaaaggggctaatggaagaaaacaaagttcaaataactgttttaaatcctaagtctgtcaccatgggccaactgtacggacagtttgattcagtgtcccatgaatggtctgatggggtccttgctgtcagttttagagcatttgcctcttcagtgactccagataggaaatggttaatttttgatggcccagtagatgcagtgtggattgagaatatgaacactgtgctggatgacaacaagaagctatgtctgatgagtggggagattattcagatgtcaccacaaatgaatctaatttttgagccaatggatttagaagttgcttcccctgccactgtttccagatgtggcatgatttacatggagcctcacatgttaggctggagaccactgatgttgtcctgggtgaatctgttacctgcgtcagtcagtgttattcaaaaggaattcataatgggcttatttgacagaatggtccctgtttcggttgaatttattagaaagcatacaaaggaattatctcctacttccgatacaaacttggtccggtccttaatgaatctaatagactgttttatggatgattttgctgatgaagtcaaactaaaggagagaaatgatcgagaaacttactctttgcttgagggcatttttctgttttcattgatctggtccgttggtgcttcttgtacagatgatgatcgattgaaatttaataagattcttcgagaactaatggaaagtccaatttcagatcgaactcgaaatacgtttaaattacagagtggtactgagcaaacatcctcaaaggcactaactgtcccatttcctgaaaaaggaacaatttatgattatcaatttgtcactgagggaataggaaaatgggaaccatggataaagaaattgaaagaagctcctccaattcctaaagatgtaatgtttaatgaaatcattgtgccaactctggacacaattcgatactctgcattaatggaattgctgaccacccatcaaaagccttcaatatttgtaggaccaacaggaactgggaaaagtgtttacattacgaattttcttttaaatcaactaaataaggaaatctacaaacctctgctaattaacttctcagcacaaactacagcagctcaaactcagaatattgtcatgtcaaaattggacaagagaagaaagggagtttttggtcctcctttgggcaagagaatggttgtctttgtagatgatgtcaatatgcctgctcgggaggtatatggggctcaacctcccattgagttacttagacagtggttagaccactggaactggtatgatctaaaagattgttccatgattaaactagtggacattcagatcatgtgtgctatgggacctccaggtggtggtcgaaatccagtaactcctcgatacatgcgacatttcaatattataacaatcaatgagtttagtgataaatccatgtatacaatcttctctagaatcttaacttggcatttagaaatctgttataaatttccagatgaatttctagatttgaccacacaaatcgtaaatggcacaatgactctgtataaagaagcaatgaagaatctcttgcctactccagctaaatctcactacttgttcaacctccgtgatttctcccgtgtcattcaaggtgtttgtttgtcaagaccagaaacaacagaaaccacagaagtgattaaacgtctttgggttcatgaggtccttcgagtgtattatgaccgccttctggacaatacagacagaagctggctcatcaactacattcaagaaattttgagaaactacatgtatgaagattttcatgagctttttcagcgtttggattttgataatgatggcatggtggaagcagatgacttacgcagcttaatgttttgtgatttccatgatcccaagagggaggataccaactacagagaaatcgcagatgtggataatcttcgaatgatagtagaaattcacctagaagaatacaacaatataagcaaaaaacccatgaaccttgtcttgtttcgatttgccatagagcacatcagcagaatttccaggatcctgaagcagcctcgcagccatgctctcctagtaggggttggagggagtggaaggcagtctgtcaccagattagctgcccacatggctgattattcagttttccaagttgaaatctctaaggggtatgatactactgaatggcatgaagatttaaaagtgatcttaaggaaatgtgcggaaggtgagatgcagggtgtcttcctgtttacagatactcaaattaaagaagagtcttttctggaagatgtcagtaatctgctaaatgctggggagattccaaatctctttgcattagatgagaagcaagagatatgtgataagatgcgtcagttagatcgccagcgggataaaaccaagcaaacagatggcagccccatagcccttttcaacatgtttattgatcattgccgcagccaactgcatgtggtccttgccatgagtcccattggagatgcatttcggaatcgtcttagaaagttccctgctcttgttaactgctgtaccattgactggtttcagtcatggcctgaagatgcactccaggcagttgcctcacgattcttggaagaaattgaaatgtcagaggaaatacgagatggctgtatcgacatgtgtaaaagcttccacacttctactatagatttatccaaatctttctttgttgaacttcaaagatacaattatgtgactcctacctcttacctcgaattaatctccaccttcaaactgttgttagaaaagaaaagaagtgaagtaatgaaaatgaaaaagagatatgaagtgggtttggagaaactggattctgcttcatctcaagtagccacaatgcagatggagttggaggcactacatcctcaattaaaagttgctagcaaagaggttgatgaaatgatgataatgattgagaaagagtctgtagaagttgccaaaactgaaaaaatagtgaaagctgatgaaacaatagcgaatgaacaagctatggcttccaaagccatcaaagatgagtgcgatgctgacctggcaggtgccttgccaatattagagtcagcactggccgcccttgatactcttactgcacaggatattacagtggtaaaatccatgaagagtcctcctgctggtgtcaagcttgttatggaagctatatgcatcttgaaaggaatcaaagctgacaaaatccctgacccaacaggttcagggaaaaaaattgaggatttctggggcccagctaagagacttcttggtgacatgaggtttctgcagtcacttcatgaatatgacaaggacaatattcctccagcttatatgaatatcataagaaaaaattatattccaaatccagattttgtaccagaaaaaatcagaaatgcttctacagcggccgaaggtctgtgcaaatgggtcatagcaatggattcatatgataaagtggcaaaaatagtagctcccaaaaagataaaactggctgcagctgaaggggagcttaaaattgccatggatggtcttagaaagaagcaggcagcccttaaggaagttcaggacaagctggccaggcttcaagacacacttgaattaaataaacaaaagaaggctgacctggaaaaccaggttgacctttgcagcaaaaaactagaacgagctgaacagttgattggaggccttggaggtgagaaaactcgatggagccacacagctctggagctaggtcagctgtacatcaacttgactggggatatcctcatttcctccggagtggttgcttacctcggagccttcacatccacctatagacagaatcaaactaaagagtggacaactttgtgcaaaggaagagatatcccctgctcagatgattgctctcttatgggtaccctgggagaagctgtgacaattcgaacttggaatattgctggattaccttctgactcattttccattgataatgggataatcataatgaatgcaagaaggtggcctctgatgatagatcctcaaagtcaggctaataaatggatcaagaacatggaaaaagccaatagtctttatgtgattaaacttagtgaacctgactatgtcaggactctggaaaattgcatccagtttggtactcctgtgttgctagaaaatgttggcgaagaactagatcctattttggaacctcttctactaaaacaaacctttaagcagggtgggagtacatgtatccggcttggggactccacaattgaatatgcacctgacttccgcttctatattactaccaagttaagaaatcctcattatcttcctgaaacatcagtaaaggtaacattattaaacttcatgataacccctgagggaatgcaagatcagcttctgggaattgtggtggcacaagaaaggccagaccttgaagaagaaaagcaagccttgatattacaaggagctgaaaataaaaggcagttaaaagaaatagaagacaagattttagaagttctttcatcttcggaaggcaatatattagaagatgaaactgctattaagatattatcttcctccaaggccttggctaatgagatttctcagaagcaggaagtagccgaagagacagagaaaaagattgacaccacccgcatgggctatcgtcctattgccatccattcttccatcctatttttttctcttgctgatttagccaacattgagcccatgtaccagtattcactgacctggtttattaaccttttcatcctgtctattgaaaattcagagaaatcagaaattttggcaaaaaggcttcagattctcaaggatcactttacttattcactgtatgttaatgtctgccggtcactctttgaaaaggataagctgctcttttccttttgtctaaccataaatctactgctgcatgagcgggcgattaataaagctgagtggagatttctgctaactggtggcattggactggataatccttatgccaacctttgtacatggcttcctcagaaatcctgggatgaaatatgtcgattagatgatttgcctgccttcaaaaccattcgtagagagtttatgcgcttaaaggatggatggaagaaagtatatgatagtttggaaccacaccatgaggttttccctgaagaatgggaagataaagcaaatgagtttcaaaggatgcttattattcgttgcttgaggccagacaaggttattccaatgttgcaggaatttataatcaacagattgggacgtgcattcattgaaccacccccctttgatttagccaaggcatttggagacagtaactgctgtgcaccactgattttcgtgctctctcctggagcagatcccatggctgcccttctaaaatttgctgatgaccagggatatgggggatcaaaacttagctctttatctcttggtcaaggccaagggcccattgctatgaagatgttagaaaaagctgtcaaggaaggaacatgggttgttcttcagaattgtcaccttgccacctcttggatgccaacccttgagaaagtctgtgaggagttaagcccagagtcaacacatccagatttccgaatgtggctaacgagttacccatctccaaatttccctgtgtcagtactgcagaatggagtgaaaatgaccaatgaagcaccaaaaggtttacgggctaatatcattcgatcatacctcatggacccgatctctgatccggagttctttggcagctgcaaaaagcctgaggaattcaagaaattgctttatggcctgtgtttctttcatgctttggtacaagaaagacggaaatttggacccctagggtggaatattccttatgagttcaatgagacagatctgagaatcagcgtacagcagctccacatgttcctgaaccagtatgaggaactgccgtatgaggctctgcggtacatgactggcgaatgcaattacggaggcagagtgaccgatgactgggaccggcgcacgctgcgcagcattctaaacaaattcttcaatcccgaattagttgaaaattcagactataagttcgactcaagtggcatctattttgttcctccttctggtgatcacaaaagctacatcgaatacacaaagactctgccactgaccccagcaccagaaatctttgggatgaatgccaatgcagatatcactaaggatcagtcagaaactcagctgctatttgataacattcttcttacacagtctcgttcagcaggtgctggtgcaaaatcatcagatgaagtagtgaatgaggtcgctagtgacatcttgggcaaacttccaaacaacttcgacatcgaggctgccatgaggaggtacccaacaacttatactcagagcatgaacactgtacttgtccaagagatgggacggttcaataagttactgaagaccataagagattcgtgcgtaaatattcaaaaagcaatcaaggggcttgcagtcatgtctacagatcttgaagaagtggttagcagcattttgaatgtcaaaattccagaaatgtggatgggtaaatcctacccaagccttaaaccacttggcagctatgtgaatgacttccttgcaagactaaaattcttgcagcaatggtatgaggttggtcctcctccagtcttctggctttctggcttcttcttcacacaagccttcctgaccggtgcccagcagaactacgccaggaaatacacaattcctattgatcttcttgggtttgactatgaagtgatggaagacaaagaatacaagcatcctcctgaggatggtgttttcattcacggattatttctggatggagcttcctggaatagaaagatcaagaaacttgcagaatcgcatcccaaaattctttatgatacagtgcctgtgatgtggctaaagccctgtaagagggcagatataccaaaacggccaagttatgttgctccattgtataagacaagtgagcggagaggagtattatccaccactggccattccacgaattttgtgattgccatgactcttccctctgaccaacccaaggaacactggattggacgaggtgtagcactgttatgtcaacttaattcataaccagaagacatcatttccttgttcctatttcttgttggctggctgagtagagaaagcatattttactacttaaacctttttttttgtttgtttaaatacatttgactaaagttataattatgaatttacttatgagcaaatgcagctaaacttaatatgactcatacttaaatgtaaggaaatgttctgaaataaagactaaagaaaacacactggca

SEQ ID NO: 128539 - DNA, 1937 bp, Homo sapiens
  Payload ID: 5160
  Gene Symbol: DNAH7
  Gene Name: dynein, axonemal, heavy chain 7
  Uniprot ID: Q8WXX0
  ENST ID: ENST00000410072
  CDS Start-End: 102-1607
gagaccgctgcaagtcccggggccctgcctctatcgtcctaggggttccgcgggcaggagcaacccagaagcaccggtgaggccagcgcgtcctcgcagccatgagcagtgagcaggataaatcggccagcaaagaaaaatccaagaaaccagtaagatttctaccacagctgtctatggagaaattagccagcaaagaaaagttcaaggcaccagcaagagctttaccacagctgtctatggtgagtacaaagccccactggcagcaggcagctccatcattccatttgagtgtaaagcaggatgatgagagtccagaaccatttagtgttaaaaatgaacagtcccatgctgaatacatggaacgttttggaaaaaagggcaaattaccccaccaagttgatgatagttatgttggaccatctacttccaaatcaaagggcaaatctccacataaagaacgagaaaactttagaagtactcttgttaatgtcattatgcaacaagatgctgacttagactcagctgtccctgatggaagcacaattccaaaaccgaccgcttctgctatagagaaagacatcttgagatattactattatattcaccatggaattgatacagaccatgtagccccaatggaagattcttggctagaacacgtactggatttagttccacaacatctgaaagtcttcactgacagcatagttacattatctgatgaaatgagagaggattatcttcttagtgtaaggaaatccatagttgattttgttttaaaagatcctcgagagaaaggagatgataagaagacagatgaacttccagcccatcgtgctgaaatggaaattctgccaaaaccttggaggaaatcttttttagctgcaagcagttatattagggatcacttgaatgcaatgaaccccacaatgctggctgtactagatttgtggcacactaattttaaaaaattacgtttagttgatatcaaagaatttcataattgccaggatgcattagagctgtcaagttttcagaacattatcatgagacacatggactctgccaaagagactctacttaaaatgtggtttccagaagtgcagaatatttattaccaaggtaataaaaaaaagcaattgccaactggtgacagcagtgccaaattggaatcttttttcaactgtgctgctgcacttatgactttacagctgcaggacctcactttagtctccatgcaagatttcacggacttaattgcacaacccccagattctgttagagcttttgaacatccaggtttcatcatgaggctgattcttgataatgacaccattaagtttgaacctgagttgagtgactatatagatatctttctaaatgtttatgacgtcatgattaaagctgtcagttttgtgccaagagttgagacaaaattgtattccaagtggagaaacaaagcaaaaccaggacatttttacttttctcatattcaaaggtctgtcacctttcagcattctgaagtttcgtctcctcagaactctcattttaagattgtgtcacccttcagtgttcttggctttacatggagatgccaattatgacttccaactttgctcgaccttgaggctttgtttcctggcagcccctcccatgcatccaccttgccggaaactcattaaagcaaagcttagaccaccaaggatcagcagggtccccagggcagctgctcacttctgcacataatgacctttcaactcatgctttctctcattttggtcccttagacttttttttttgttgttatttccttagctatacgttataaaagataaagtcagctttattatcctggcatatttatgtgttttgaattgagtagttgttttctggatatctattcctcatactaccatgaatagaagtctctcaag

SEQ ID NO: 128540 - DNA, 1845 bp, Homo sapiens
  Payload ID: 5160
  Gene Symbol: DNAH7
  Gene Name: dynein, axonemal, heavy chain 7
  Uniprot ID: Q8WXX0
  ENST ID: ENST00000409063
  CDS Start-End: 104-1627
atctggctttgttttttctttacgtcacttagcgccagtttgttctggccgtgtctcccactagaatgagttaagcccagagtcaacacatccagatttccgaatgtggctaacgagttacccatctccaaatttccctgtgtcagtactgcagaatggagtgaaaatgaccaatgaagcaccaaaaggtttacgggctaatatcattcgatcatacctcatggacccgatctctgatccggagttctttggcagctgcaaaaagcctgaggaattcaagaaattgctttatggcctgtgtttctttcatgctttggtacaagaaagacggaaatttggacccctagggtggaatattccttatgagttcaatgagacagatctgagaatcagcgtacagcagctccacatgttcctgaaccagtatgaggaactgccgtatgaggctctgcggtacatgactggcgaatgcaattacggaggcagagtgaccgatgactgggaccggcgcacgctgcgcagcattctaaacaaattcttcaatcccgaattagttgaaaattcagactataagttcgactcaagtggcatctattttgttcctccttctggtgatcacaaaagctacatcgaatacacaaagactctgccactgaccccagcaccagaaatctttgggatgaatgccaatgcagatatcactaaggatcagtcagaaactcagctgctatttgataacattcttcttacacagtctcgttcagcaggtgctggtgcaaaatcatcagatgaagtagtgaatgaggtcgctagtgacatcttgggcaaacttccaaacaacttcgacatcgaggctgccatgaggaggtacccaacaacttatactcagagcatgaacactgtacttgtccaagagatgggacggttcaataagttactgaagaccataagagattcgtgcgtaaatattcaaaaagcaatcaaggggcttgcagtcatgtctacagatcttgaagaagtggttagcagcattttgaatgtcaaaattccagaaatgtggatgggtaaatcctacccaagccttaaaccacttggcagctatgtgaatgacttccttgcaagactaaaattcttgcagcaatggtatgaggttggtcctcctccagtcttctggctttctggcttcttcttcacacaagccttcctgaccggtgcccagcagaactacgccaggaaatacacaattcctattgatcttcttgggtttgactatgaagtgatggaagacaaagaatacaagcatcctcctgaggatggtgttttcattcacggattatttctggatggagcttcctggaatagaaagatcaagaaacttgcagaatcgcatcccaaaattctttatgatacagtgcctgtgatgtggctaaagccctgtaagagggcagatataccaaaacggccaagttatgttgctccattgtataagacaagtgagcggagaggagtattatccaccactggccattccacgaattttgtgattgccatgactcttccctctgaccaacccaaggaacactggattggacgaggtgtagcactgttatgtcaacttaattcataaccagaagacatcatttccttgttcctatttcttgttggctggctgagtagagaaagcatattttactacttaaacctttttttttgtttgtttaaatacatttgactaaagttataattatgaatttacttatgagcaaatgcagctaaacttaatatgactcatacttaaatgtaaggaaatgttctgaaataaagactaaagaaaacacactggca

SEQ ID NO: 128541 - DNA, 559 bp, Homo sapiens
  Payload ID: 5160
  Gene Symbol: DNAH7
  Gene Name: dynein, axonemal, heavy chain 7
  ENST ID: ENST00000427816
  CDS Start-End: 197-559
ataacaaccaaacctagccgcctagcggcgcgccagcagggggagccacagcccagagcacccccagagtgctaatggcggtgtgcttgggtgagaggcggctctgcgaggagttgcagcgggtttgggttctaaggataaatcggccagcaaagaaaaatccaagaaaccagtaagatttctaccacagctgtctatggagaaattagccagcaaagaaaagttcaaggcaccagcaagagctttaccacagctgtctatggtgagtacaaagccccactggcagcaggcagctccatcattccatttgagtgtaaagcaggatgatgagagtccagaaccatttagtgttaaaaatgaacagtcccatgctgaatacatggaacgttttggaaaaaagggcaaattaccccaccaagttgatgatagttatgttggaccatctacttccaaatcaaagggcaaatctccacataaagaacgagaaaactttagaagtactcttgttaatgtcattatgcaacaagatgctgacttagactcagctgtccctgatgga

SEQ ID NO: 128542 - DNA, 301 bp, Homo sapiens
  Payload ID: 5160
  Gene Symbol: DNAH7
  Gene Name: dynein, axonemal, heavy chain 7
  ENST ID: ENST00000438565
  CDS Start-End: 1-171
tacccaagccttaaaccacttggcagctatgtgaatgacttccttgcaagactaaaattcttgcaggtgttttcattcacggattatttctggatggagcttcctggaatagaaagatcaagaaacttgcagaatcgcatcccaaaattctttatgatacagtgcctgtgatgtggctaaagccctgtaagagggcagatataccaaaacggccaagttatgttgctccattgtataagacaagtgagcggagaggagtattatccaccactggccattccacgaattttgtgattgccat

SEQ ID NO: 128543 - DNA, 14360 bp, Homo sapiens
  Payload ID: 5161
  Gene Symbol: DNAH8
  Gene Name: dynein, axonemal, heavy chain 8
  ENST ID: ENST00000327475
  CDS Start-End: 110-14233
cccggggcagcgcaaccgctggggccggcctcagtgggctgagtggtcggggcatcggggcccagagagcggctggtttcgaagtataaagcattccgcacgacgggggatggagaaggatgctgaagatggcgccccttctgagggagcagaggctcctccctctacggaagaggctgcccctccccgttcagaagaggaagaggccccgcgccctccgacagtggaggccccggcagaagatggtttctctccttccgcagaagatgctgtttcttctgtggtggattatcgggatctcattccttctgaagaagggatagttcttccagatgatcatgaagcggatctgaatagagttcgacagaggcttgcaccgcgaccggttcagtcagtgatttcggaagtgctgtccttgccgtcttcccggaggtcctccagataccgccggagtatgagtggccttcccaatctacaggaaacattaaaagagagacaggcaagatttagagaggcaagggaaagccgaagactgaaaattgacccttcatacaaatatatatttgaaattctagcagaaaatcttggcctggacatagtaactgttgaagaattaattttggattgcccatctctggaagcatttactaatttttttgcgaaagatggttgtaagacactgaaatttttgtaccaagaaggagatgtacctggtattgaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctggatcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacaggagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcctttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtggaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccgcatctccctgcagtatctgacaacatcaatgaggtgacatttcatgcaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacagatcattatgagagttaaacttgcaagctgtggttttcttgaaaatgttatcttggctcaaaaattttacgttctttacaaactctgtgaagagcaacttactaaacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctacgtggataagcgaattggaagcacatatgggccaccaggagggagaaaaatgactgtatttattgatgatattaatatgcctgtgattaatgagtggggagatcagataactaatgagattgtgcgacagatgatggaaatggaaggaatgtacagcttggacaagcctggagacttcactactattgttgatgtgcagctcatagcagcaatgatccaccctggaggtggtcgaaatgatattccacaacgtttaaaaagacaatttactgtgtttaattgtacattgccttcaaatgcttcaatagacaaaatttttggaattattggatgtggatactttgatccttgtagaagtttcaagcctcaaatatgtgagatgattgtgaatttagtctcagtgggtagagtgctgtggcaatggactaaggtgaagatgctgccaactccttctaaatttcattacatcttcaatcttcgagatctttccagaatttggcaaggaatgttgaccataaaagctgaggagtgcgcttcaatccctactctcctgtcccttttcaaacacgagtgcagcagagtaattgcagacagatttataactcctgaagatgagcagtggtttaatgcacatcttactcgtgcagttgaagaaaatattggctctgatgcagcgtcgtgtattcttcctgaaccatactttgtggattttcttcgtgagatgccagaaccaactggtgatgaacctgaagactctgtgtttgaagtacccaaaatatatgaattgatgccatcctttgactttctggctgaaaaactccagttttaccagagacagttcaatgaaatcattagaggaacatctcttgatctggtgttttttaaagatgcaatgactcatcttattaagatttcacgaataattcgaacgtcgtgtggaaatgcattgctggtgggtgttggtggttccggaaaacaaagtctttcaagattggcctcttttattgctggctatcaaatattccagataacattaaccaggtcttacaatgtgactaatctaacagatgatttaaaagctttgtacaaagttgctggtgctgatggaaaaggcatcactttcatctttactgacagtgaaataaaagatgaggcatttctagaataccttaacaacttgctatcttcaggggagatctccaacttgtttgcacgagatgagatggatgaaatcacccaaggtctgatttcagtgatgaagagggagctacctcgccatcctcctacctttgataatttgtatgaatacttcatttcaagatcaaggaagaacttacatgttgttctctgcttttctccagttggtgagaagttccgtgcccgttctttgaaatttcctggcttgatatcaggttgcactatggactggttcagccgctggccaagggaggctctgattgctgtggcctcctacttcctttcagactataatattgtctgctctagtgaaattaaaagacaagttgtagaaacaatgggcctgtttcatgacatggtttcagagagctgtgaaagttatttccaaagataccgccgaagagcacatgtgactcccaaatcttacctctcatttataaatggttataaaaacatttatgctgaaaaggtgaagttcattaatgaacaggctgaacgtatgaatattggtcttgataaactaatggaggcaagtgaatctgttgctaaactctctcaggatcttgcagtcaaggagaaggagttggcagtggcttccataaaagcagacgaagtattagcagaagtcacagtaagcgctcaggcttcagccaaaattaaaaatgaagtacaggaggtaaaggacaaagcccaaaaaattgtggatgaaattgatagtgaaaaagtgaaagctgaaagcaagcttgaggcagctaaacctgcactggaagaagcagaagcagccctgaatactatcaagccaaatgatattgccacagtcaggaaacttgcaaaaccaccacatcttattatgagaatcatggactgtgttctgttactatttcaaaagaaaattgaccctgttactatggatccagaaaaatcttgctgtaagccatcatggggagagtcattaaagttgatgagtgcaacaggattcctgtggagccttcagcagttccctaaggacactataaatgaagagactgttgagttactacagccatattttaatatggatgattatacttttgaaagtgccaaaaaagtctgtgggaatgtggctggtctcctgtcttggacacttgctatggcaatattttatggcatcaatagagaagtgttgcctctgaaggccaacctggccaagcaggaaggccggttagcagttgctaatgctgagttagggaaggcacaagccctgctggatgagaagcaagctgagctggataaagtacaggcaaaatttgatgcagcaatgaatgagaaaatggatttgcttaatgacgctgatacgtgccggaaaaagatgcaggccgcctccactctcatcgatgggctgagtggagaaaaaatccggtggacccagcaaagtaaagaattcaaagctcagattaatagacttgtaggtgatattctgctgtgcacgggattcctttcctaccttggtcctttcaatcagatatttaggaactatttgcttaaagatcaatgggaaatggagttgagagcacggaaaattcctttcacagaaaacctgaatcttatttcaatgttggtggatcctccaactattggtgagtgggggctacagggattaccaggagatgatctctcaattcagaatggcattattgtgacaaaggccaccagatacccactcctcatagacccacaaactcaaggcaaaacttggattaaatcaaaggaaaaagaaaatgatttacaggtgacatctctgaaccataaatattttcgcacacacttggaggacagcctttccttgggccgaccccttctcattgaggacattcatgaagagctggatccagccttggataatgtattagaaaagaattttattaaatctggcaccactttcaaggtgaaagtcggtgataaggaatgtgatatcatggatacatttaaactttacattactacgaagttaccaaatcctgcctttaccccagagattaatgctaaaacgtcagtcattgatttcactgttacaatgaaaggacttgagaatcagttactaaggagagtcattctaacagagaaacaggagttagaggctgagagggttaaacttttggaggatgttacttttaataagcggaagatgaaagaacttgaagataacctcctctataaattaagtgctacaaaaggctcattggtagatgacgaatctctcattggtgtacttcgaactaccaagcagacagcagctgaggtaagtgaaaagttgcatgtggctgcagaaactgagatcaagatcaacgcggctcaggaggagttccggcccgcagccacccgcggaagcatcctctacttcctcatcacagagatgagcatggtcaacatcatgtatcagacgtcattggcccagttcttgaagttatttgaccagtccatggccagatctgaaaagtcaccactacctcaaaagagaattacaaatattatcgagtacctgacatatgaagtttttacatactctgtcagaggcctatacgaaaaccacaaattcctgtttgtactcctcatgaccttaaagattgaccttcagagagggacagttaagcacagagagtttcaagctctcattaaagggggagcagctctggacctgaaagcctgtcctcccaaaccctatcgctggatccttgacatgacttggctgaatcttgtggagctgagtaaacttccacaatttgcagaaattatgaaccagatatctcgtaatgagaaggggtggaaaagctggtttgataaagatgctccagaggaggaaattatccctgatggatataatgattcactagatacctgccataaacttttacttatcaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgatgcattggccaagaaactgaaactggaatgtagaactatctcaatggggcaaggacaagaagtacatgctcgaaagctgattcagatgtcaatgcagcagggtggttgggtattactacaaaattgccaccttggcctggaattcatggaagaattactagagacgctaattaccactgaagccagtgatgattctttccgagtatggataactacggagccccatgatcgatttccaattacattgcttcagacctctctcaaattcactaatgagccaccccaaggtgtacgcgcaggtttgaaaagaacatttgctggaattaatcaagaccttctggacatcagtaatttacccatgtggaagccgatgctttacacagtagcatttttacactccactgtgcaggagcgacgaaaatttggccccttaggatggaatattccctacgaattcaattctgctgacttttcagccagtgttcagtttattcagaatcaccttgatgaatgcgatattaagaaaggtgtatcatggaatacggttcggtacatgatcggagaagtacaatatggaggcagagtgacagatgactttgacaaacgtctacttaattgctttgccagagtctggttcagtgagaagatgtttgaaccgtcattctgcttttatactggatataaaatccccttatgcaaaaccttagaccagtattttgaatacatccagtcactgccatccctagataaccctgaagtctttgggcttcaccctaatgctgatatcacgtatcagagtaacactgcttctgctgttcttgaaacaattaccaacattcaacccaaagagagtggaggtggtgtgggagagacccgggaggctattgtttatagattatctgaagatatgctgagtaaactccctcctgattacattcctcatgaggtgaaatctcgtttgataaagatgggccatcttaattcaatgaacatatttcttagacaagaaattgacagaatgcaaagagtcatttcaatactccgcagtagcctgagtgatctaaaattggccattgaaggaacaatcattatgagtgagaatctgagagatgctctggacaacatgtatgatgctcgtatacctcagctctggaaaagagtgtcttgggattcgtccacactgggcttctggttcactgaacttttggaaagaaatgctcagttttctacgtggatatttgaagggaggcctaatgtgttttggatgactggtttctttaatccccaaggcttcctcacagcaatgaggcaagaagtgacccgtgcccacaaaggctgggcactggacactgtgaccatccacaatgaagttctgagacagaccaaggaggagatcacgtcaccccctggggaaggtgtgtatatttatgggctctacatggatggagcagcctgggacagacggaatgggaagctcatggaatccacccccaaggtactcttcacgcagttacccgtgctccacatctttgccattaactccacggcacccaaggaccccaagctgtatgtgtgtcctatttacaagaaacccaggcgaactgatttgaccttcatcactgtggtatatttacgaacagtgttgtccccggatcactggatcctgagaggagtggcccttttgtgtgacatcaagtaagttcatttccatctgctcagggcaccagaacccacatagacagcctgtgctattgagggactcagtgatgtgtgtgtcttttctccccagtaattccttaattactctttctacattaaaaagttga

SEQ ID NO: 128544 - DNA, 13864 bp, Homo sapiens
  Payload ID: 5161
  Gene Symbol: DNAH8
  Gene Name: dynein, axonemal, heavy chain 8
  Uniprot ID: Q96JB1
  ENST ID: ENST00000359357
  CDS Start-End: 255-13727
tcttcccggaggtcctccagataccgccggagtatgagtggccttcccaatctacaggaaacattaaaagagagacaggcaagatttagagaggcaagggaaagccgaagactgaaaattgacccttcatacaaatatatatttgaaattctagcagaaaatcttggcctggacatagtaactgttgaagaattaattttggattgcccatctaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctggatcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacaggagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcctttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtggaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccgcatctccctgcagtatctgacaacatcaatgaggtgacatttcatgcaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacagatcattatgagagttaaacttgcaagctgtggttttcttgaaaatgttatcttggctcaaaaattttacgttctttacaaactctgtgaagagcaacttactaaacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctacgtggataagcgaattggaagcacatatgggccaccaggagggagaaaaatgactgtatttattgatgatattaatatgcctgtgattaatgagtggggagatcagataactaatgagattgtgcgacagatgatggaaatggaaggaatgtacagcttggacaagcctggagacttcactactattgttgatgtgcagctcatagcagcaatgatccaccctggaggtggtcgaaatgatattccacaacgtttaaaaagacaatttactgtgtttaattgtacattgccttcaaatgcttcaatagacaaaatttttggaattattggatgtggatactttgatccttgtagaagtttcaagcctcaaatatgtgagatgattgtgaatttagtctcagtgggtagagtgctgtggcaatggactaaggtgaagatgctgccaactccttctaaatttcattacatcttcaatcttcgagatctttccagaatttggcaaggaatgttgaccataaaagctgaggagtgcgcttcaatccctactctcctgtcccttttcaaacacgagtgcagcagagtaattgcagacagatttataactcctgaagatgagcagtggtttaatgcacatcttactcgtgcagttgaagaaaatattggctctgatgcagcgtcgtgtattcttcctgaaccatactttgtggattttcttcgtgagatgccagaaccaactggtgatgaacctgaagactctgtgtttgaagtacccaaaatatatgaattgatgccatcctttgactttctggctgaaaaactccagttttaccagagacagttcaatgaaatcattagaggaacatctcttgatctggtgttttttaaagatgcaatgactcatcttattaagatttcacgaataattcgaacgtcgtgtggaaatgcattgctggtgggtgttggtggttccggaaaacaaagtctttcaagattggcctcttttattgctggctatcaaatattccagataacattaaccaggtcttacaatgtgactaatctaacagatgatttaaaagctttgtacaaagttgctggtgctgatggaaaaggcatcactttcatctttactgacagtgaaataaaagatgaggcatttctagaataccttaacaacttgctatcttcaggggagatctccaacttgtttgcacgagatgagatggatgaaatcacccaaggtctgatttcagtgatgaagagggagctacctcgccatcctcctacctttgataatttgtatgaatacttcatttcaagatcaaggaagaacttacatgttgttctctgcttttctccagttggtgagaagttccgtgcccgttctttgaaatttcctggcttgatatcaggttgcactatggactggttcagccgctggccaagggaggctctgattgctgtggcctcctacttcctttcagactataatattgtctgctctagtgaaattaaaagacaagttgtagaaacaatgggcctgtttcatgacatggtttcagagagctgtgaaagttatttccaaagataccgccgaagagcacatgtgactcccaaatcttacctctcatttataaatggttataaaaacatttatgctgaaaaggtgaagttcattaatgaacaggctgaacgtatgaatattggtcttgataaactaatggaggcaagtgaatctgttgctaaactctctcaggatcttgcagtcaaggagaaggagttggcagtggcttccataaaagcagacgaagtattagcagaagtcacagtaagcgctcaggcttcagccaaaattaaaaatgaagtacaggaggtaaaggacaaagcccaaaaaattgtggatgaaattgatagtgaaaaagtgaaagctgaaagcaagcttgaggcagctaaacctgcactggaagaagcagaagcagccctgaatactatcaagccaaatgatattgccacagtcaggaaacttgcaaaaccaccacatcttattatgagaatcatggactgtgttctgttactatttcaaaagaaaattgaccctgttactatggatccagaaaaatcttgctgtaagccatcatggggagagtcattaaagttgatgagtgcaacaggattcctgtggagccttcagcagttccctaaggacactataaatgaagagactgttgagttactacagccatattttaatatggatgattatacttttgaaagtgccaaaaaagtctgtgggaatgtggctggtctcctgtcttggacacttgctatggcaatattttatggcatcaatagagaagtgttgcctctgaaggccaacctggccaagcaggaaggccggttagcagttgctaatgctgagttagggaaggcacaagccctgctggatgagaagcaagctgagctggataaagtacaggcaaaatttgatgcagcaatgaatgagaaaatggatttgcttaatgacgctgatacgtgccggaaaaagatgcaggccgcctccactctcatcgatgggctgagtggagaaaaaatccggtggacccagcaaagtaaagaattcaaagctcagattaatagacttgtaggtgatattctgctgtgcacgggattcctttcctaccttggtcctttcaatcagatatttaggaactatttgcttaaagatcaatgggaaatggagttgagagcacggaaaattcctttcacagaaaacctgaatcttatttcaatgttggtggatcctccaactattggtgagtgggggctacagggattaccaggagatgatctctcaattcagaatggcattattgtgacaaaggccaccagatacccactcctcatagacccacaaactcaaggcaaaacttggattaaatcaaaggaaaaagaaaatgatttacaggtgacatctctgaaccataaatattttcgcacacacttggaggacagcctttccttgggccgaccccttctcattgaggacattcatgaagagctggatccagccttggataatgtattagaaaagaattttattaaatctggcaccactttcaaggtgaaagtcggtgataaggaatgtgatatcatggatacatttaaactttacattactacgaagttaccaaatcctgcctttaccccagagattaatgctaaaacgtcagtcattgatttcactgttacaatgaaaggacttgagaatcagttactaaggagagtcattctaacagagaaacaggagttagaggctgagagggttaaacttttggaggatgttacttttaataagcggaagatgaaagaacttgaagataacctcctctataaattaagtgctacaaaaggctcattggtagatgacgaatctctcattggtgtacttcgaactaccaagcagacagcagctgaggtaagtgaaaagttgcatgtggctgcagaaactgagatcaagatcaacgcggctcaggaggagttccggcccgcagccacccgcggaagcatcctctacttcctcatcacagagatgagcatggtcaacatcatgtatcagacgtcattggcccagttcttgaagttatttgaccagtccatggccagatctgaaaagtcaccactacctcaaaagagaattacaaatattatcgagtacctgacatatgaagtttttacatactctgtcagaggcctatacgaaaaccacaaattcctgtttgtactcctcatgaccttaaagattgaccttcagagagggacagttaagcacagagagtttcaagctctcattaaagggggagcagctctggacctgaaagcctgtcctcccaaaccctatcgctggatccttgacatgacttggctgaatcttgtggagctgagtaaacttccacaatttgcagaaattatgaaccagatatctcgtaatgagaaggggtggaaaagctggtttgataaagatgctccagaggaggaaattatccctgatggatataatgattcactagatacctgccataaacttttacttatcaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgatgcattggccaagaaactgaaactggaatgtagaactatctcaatggggcaaggacaagaagtacatgctcgaaagctgattcagatgtcaatgcagcagggtggttgggtattactacaaaattgccaccttggcctggaattcatggaagaattactagagacgctaattaccactgaagccagtgatgattctttccgagtatggataactacggagccccatgatcgatttccaattacattgcttcagacctctctcaaattcactaatgagccaccccaaggtgtacgcgcaggtttgaaaagaacatttgctggaattaatcaagaccttctggacatcagtaatttacccatgtggaagccgatgctttacacagtagcatttttacactccactgtgcaggagcgacgaaaatttggccccttaggatggaatattccctacgaattcaattctgctgacttttcagccagtgttcagtttattcagaatcaccttgatgaatgcgatattaagaaaggtgtatcatggaatacggttcggtacatgatcggagaagtacaatatggaggcagagtgacagatgactttgacaaacgtctacttaattgctttgccagagtctggttcagtgagaagatgtttgaaccgtcattctgcttttatactggatataaaatccccttatgcaaaaccttagaccagtattttgaatacatccagtcactgccatccctagataaccctgaagtctttgggcttcaccctaatgctgatatcacgtatcagagtaacactgcttctgctgttcttgaaacaattaccaacattcaacccaaagagagtggaggtggtgtgggagagacccgggaggctattgtttatagattatctgaagatatgctgagtaaactccctcctgattacattcctcatgaggtgaaatctcgtttgataaagatgggccatcttaattcaatgaacatatttcttagacaagaaattgacagaatgcaaagagtcatttcaatactccgcagtagcctgagtgatctaaaattggccattgaaggaacaatcattatgagtgagaatctgagagatgctctggacaacatgtatgatgctcgtatacctcagctctggaaaagagtgtcttgggattcgtccacactgggcttctggttcactgaacttttggaaagaaatgctcagttttctacgtggatatttgaagggaggcctaatgtgttttggatgactggtttctttaatccccaaggcttcctcacagcaatgaggcaagaagtgacccgtgcccacaaaggctgggcactggacactgtgaccatccacaatgaagttctgagacagaccaaggaggagatcacgtcaccccctggggaaggtgtgtatatttatgggctctacatggatggagcagcctgggacagacggaatgggaagctcatggaatccacccccaaggtactcttcacgcagttacccgtgctccacatctttgccattaactccacggcacccaaggaccccaagctgtatgtgtgtcctatttacaagaaacccaggcgaactgatttgaccttcatcactgtggtatatttacgaacagtgttgtccccggatcactggatcctgagaggagtggcccttttgtgtgacatcaagtaagttcatttccatctgctcagggcaccagaacccacatagacagcctgtgctattgagggactcagtgatgtgtgtgtcttttctccccagtaattccttaattactctttctacattaaaaagttgatgttctaaaa

SEQ ID NO: 128545 - DNA, 955 bp, Homo sapiens
  Payload ID: 5161
  Gene Symbol: DNAH8
  Gene Name: dynein, axonemal, heavy chain 8
  ENST ID: ENST00000373278
  CDS Start-End: 305-955
gaagttttgctgcctgctaagctctcttagcccttcgttaattcacctgtcattgacattgaccatcttgtgttgtattcaatagtctgtcacaccaatttgattgtgcattttgctttggagaagtccttagtcttttatgtagccacagtggccagacatgcagaagacgttcaatattgctgaatgaactaatgcatttgggatagggttacagaaatgggtgcaagagaaaagggtgtggttgaattggctgtacccagcacacaggtttcgaagtataaagcattccgcacgacgggggatggagaaggatgctgaagatggcgccccttctgagggagcagaggctcctccctctacggaagaggctgcccctccccgttcagaagaggaagaggccccgcgccctccgacagtggaggccccggcagaagatggtttctctccttccgcagaagatgctgtttcttctgtggtggattatcgggatctcattccttctgaagaagggatagttcttccagatgatcatgaagcggatctgaatagagttcgacagaggcttgcaccgcgaccggttcagtcagtgatttcggaagtgctgtccttgccgtcttcccggaggtcctccagataccgccggagtatgagtggccttcccaatctacaggaaacattaaaagagagacaggcaagatttagagaggcaagggaaagccgaagactgaaaattgacccttcatacaaatatatatttgaaattctagcagaaaatcttggcctggacatagtaactgttgaagaattaattttggattgcccatctctggaagcatttactaatttttttgcgaaagatggttgtaagacactgaaatttttgtaccaagaaggagatgtacctggtattgaatgtggtcgaactattgctggagcaactaaaggggcaaaa

SEQ ID NO: 128546 - DNA, 404 bp, Homo sapiens
  Payload ID: 5161
  Gene Symbol: DNAH8
  Gene Name: dynein, axonemal, heavy chain 8
  ENST ID: ENST00000394393
  CDS Start-End: 1-404
tgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaa

SEQ ID NO: 128547 - DNA, 12940 bp, Homo sapiens
  Payload ID: 5161
  Gene Symbol: DNAH8
  Gene Name: dynein, axonemal, heavy chain 8
  ENST ID: ENST00000449981
  CDS Start-End: 1-12567
atggagaaggatgctgaagatggcgccccttctgagggagcagaggctcctccctctacggaagaggctgcccctccccgttcagaagaggaagaggccccgcgccctccgacagtggaggccccggcagaagatggtttctctccttccgcagaagatgctgtttcttctgtggtggattatcgggatctcattccttctgaagaagggatagttcttccagatgatcatgaagcggatctgaatagagttcgacagaggcttgcaccgcgaccggttcagtcagtgatttcggaagtgctgtccttgccgtcttcccggaggtcctccagataccgccggagtatgagtggccttcccaatctacaggaaacattaaaagagagacaggcaagatttagagaggcaagggaaagccgaagactgaaaattgacccttcatacaaatatatatttgaaattctagcagaaaatcttggcctggacatagtaactgttgaagaattaattttggattgcccatctctggaagcatttactaatttttttgcgaaagatggttgtaagacactgaaatttttgtaccaagaaggagatgtacctggtattgaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctggatcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacaggagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcctttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtggaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccgcatctccctgcagtatctgacaacatcaatgaggtgacatttcatgcaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacagatcattatgagagttaaacttgcaagctgtggttttcttgaaaatgttatcttggctcaaaaattttacgttctttacaaactctgtgaagagcaacttactaaacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctacgtggataagcgaattggaagcacatatgggccaccaggagggagaaaaatgactgtatttattgatgatattaatatgcctgtgattaatgagtggggagatcagataactaatgagattgtgcgacagatgatggaaatggaaggaatgtacagcttggacaagcctggagacttcactactattgttgatgtgcagctcatagcagcaatgatccaccctggaggtggtcgaaatgatattccacaacgtttaaaaagacaatttactgtgtttaattgtacattgccttcaaatgcttcaatagacaaaatttttggaattattggatgtggatactttgatccttgtagaagtttcaagcctcaaatatgtgagatgattgtgaatttagtctcagtgggtagagtgctgtggcaatggactaaggtgaagatgctgccaactccttctaaatttcattacatcttcaatcttcgagatctttccagaatttggcaaggaatgttgaccataaaagctgaggagtgcgcttcaatccctactctcctgtcccttttcaaacacgagtgcagcagagtaattgcagacagatttataactcctgaagatgagcagtggtttaatgcacatcttactcgtgcagttgaagaaaatattggctctgatgcagcgtcgtgtattcttcctgaaccatactttgtggattttcttcgtgagatgccagaaccaactggtgatgaacctgaagactctgtgtttgaagtacccaaaatatatgaattgatgccatcctttgactttctggctgaaaaactccagttttaccagagacagttcaatgaaatcattagaggaacatctcttgatctggtgttttttaaagatgcaatgactcatcttattaagatttcacgaataattcgaacgtcgtgtggaaatgcattgctggtgggtgttggtggttccggaaaacaaagtctttcaagattggcctcttttattgctggctatcaaatattccagataacattaaccaggtcttacaatgtgactaatctaacagatgatttaaaagctttgtacaaagttgctggtgctgatggaaaaggcatcactttcatctttactgacagtgaaataaaagatgaggcatttctagaataccttaacaacttgctatcttcaggggagatctccaacttgtttgcacgagatgagatggatgaaatcacccaaggtctgatttcagtgatgaagagggagctacctcgccatcctcctacctttgataatttgtatgaatacttcatttcaagatcaaggaagaacttacatgttgttctctgcttttctccagttggtgagaagttccgtgcccgttctttgaaatttcctggcttgatatcaggttgcactatggactggttcagccgctggccaagggaggctctgattgctgtggcctcctacttcctttcagactataatattgtctgctctagtgaaattaaaagacaagttgtagaaacaatgggcctgtttcatgacatggtttcagagagctgtgaaagttatttccaaagataccgccgaagagcacatgtgactcccaaatcttacctctcatttataaatggttataaaaacatttatgctgaaaaggtgaagttcattaatgaacaggctgaacgtatgaatattggtcttgataaactaatggaggcaagtgaatctgttgctaaactctctcaggatcttgcagtcaaggagaaggagttggcagtggcttccataaaagcagacgaagtattagcagaagtcacagtaagcgctcaggcttcagccaaaattaaaaatgaagtacaggaggtaaaggacaaagcccaaaaaattgtggatgaaattgatagtgaaaaagtgaaagctgaaagcaagcttgaggcagctaaacctgcactggaagaagcagaagcagccctgaatactatcaagccaaatgatattgccacagtcaggaaacttgcaaaaccaccacatcttattatgagaatcatggactgtgttctgttactatttcaaaagaaaattgaccctgttactatggatccagaaaaatcttgctgtaagccatcatggggagagtcattaaagttgatgagtgcaacaggattcctgtggagccttcagcagttccctaaggacactataaatgaagagactgttgagttactacagccatattttaatatggatgattatacttttgaaagtgccaaaaaagtctgtgggaatgtggctggtctcctgtcttggacacttgctatggcaatattttatggcatcaatagagaagtgttgcctctgaaggccaacctggccaagcaggaaggccggttagcagttgctaatgctgagttagggaaggcacaagccctgctggatgagaagcaagctgagctggataaagtacaggcaaaatttgatgcagcaatgaatgagaaaatggatttgcttaatgacgctgatacgtgccggaaaaagatgcaggccgcctccactctcatcgatgggctgagtggagaaaaaatccggtggacccagcaaagtaaagaattcaaagctcagattaatagacttgtaggtgatattctgctgtgcacgggattcctttcctaccttggtcctttcaatcagatatttaggaactatttgcttaaagatcaatgggaaatggagttgagagcacggaaaattcctttcacagaaaacctgaatcttatttcaatgttggtggatcctccaactattggtgagtgggggctacagggattaccaggagatgatctctcaattcagaatggcattattgtgacaaaggccaccagatacccactcctcatagacccacaaactcaaggcaaaacttggattaaatcaaaggaaaaagaaaatgatttacaggtgacatctctgaaccataaatattttcgcacacacttggaggacagcctttccttgggccgaccccttctcattgaggacattcatgaagagctggatccagccttggataatgtattagaaaagaattttattaaatctggcaccactttcaaggtgaaagtcggtgataaggaatgtgatatcatggatacatttaaactttacattactacgaagttaccaaatcctgcctttaccccagagattaatgctaaaacgtcagtcattgatttcactgttacaatgaaaggacttgagaatcagttactaaggagagtcattctaacagagaaacaggagttagaggctgagagggttaaacttttggaggatgttacttttaataagcggaagatgaaagaacttgaagataacctcctctataaattaagtgctacaaaaggctcattggtagatgacgaatctctcattggtgtacttcgaactaccaagcagacagcagctgaggtaagtgaaaagttgcatgtggctgcagaaactgagatcaagatcaacgcggctcaggaggagttccggcccgcagccacccgcggaagcatcctctacttcctcatcacagagatgagcatggtcaacatcatgtatcagacgtcattggcccagttcttgaagttatttgaccagtccatggccagatctgaaaagtcaccactacctcaaaagagaattacaaatattatcgagtacctgacatatgaagtttttacatactctgtcagaggcctatacgaaaaccacaaattcctgtttgtactcctcatgaccttaaagattgaccttcagagagggacagttaagcacagagagtttcaagctctcattaaagggggagcagctctggacctgaaagcctgtcctcccaaaccctatcgctggatccttgacatgacttggctgaatcttgtggagctgagtaaacttccacaatttgcagaaattatgaaccagatatctcgtaatgagaaggggtggaaaagctggtttgataaagatgctccagaggaggaaattatccctgatggatataatgattcactagatacctgccataaacttttacttatcaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgatgcattggccaagaaactgaaactggaatgtagaactatctcaatggggcaaggacaagaagtacatgctcgaaagctgattcagatgtcaatgcagcaggtatgtgacaagagactgctcctgctgcaacattattgctagaaaccccacaatcatggatgttaccacattcttctcgtgatgctcaatcctggtttttccatttttgtttatcattacctgtgaattttaaacctcagtctagtttcctcctgatattcgcatggaaagcttattccattttctatagtatatgctccattttaccttcaccaattttttgttcgttttatgatttgggagacacaccttctgatttctaagaatgcatctctagcagtcttggaatttcatgatcaatatgaataggtagtacttaaggagtgacagattgagacagttaaatttccattttcagttaaaggcagactttcatttttcattaacggatcatttcaggcaaagaaggaatatt

SEQ ID NO: 128548 - DNA, 13750 bp, Homo sapiens
  Payload ID: 5162
  Gene Symbol: DNAH9
  Gene Name: dynein, axonemal, heavy chain 9
  Uniprot ID: Q9NYC9
  ENST ID: ENST00000262442
  CDS Start-End: 69-13529
agcagaggagtgagtcctggccgcgtccccgtcgctagggaaaccgatgcagctggaggccgcgcgcgatgcggctcgcggaggagcgggccgcgctcgcggcggagaacgcggatggggaacccggcgccgaccgacgactgcgactcctggggacctacgtggccatgagcctgcggccggctgcgggcgcctgggagcgttgcgcggggagtgctgaggcggagcagctgctccaggccttcctgggccgcgatgctgccgaggggccgcggccgctgctggtggtgcggcccgggcccaggggcctggcaatacgccccgggctggaggtgggacctgagtcgggcctggctggcgctaaggcgctttttttccttcgcaccgggcccgagcctccagggcccgacagcttccgcggcgcagtggtctgcggggacctgcccgcggcacctctggagcacctagccgcgctgttctcggaggttgttctacccgtcctggccaatgagaagaatcgcctaaactggccccacatgatatgtgaggatgtcaggcggcacgcccacagcctccaatgtgacctctcagttatacttgagcaagtgaagggaaaaactttgctgcctcttccagcaggctcagaaaaaatggagtttgcggattccaaaagtgagacagtcttggattctatagataagtcagtcatctatgccattgagtctgcagtgatcaaatggagctaccaagtccaggtggtactcaagagagagtcttcccagccactcttacaaggggagaatcccacccctaaggtggagttggagttctggaagagcaggtatgaagatctgaaatacatctataatcaactgagaacaataacggtgaggggcatggccaagctcctggacaagcttcagagtagctactttccagctttcaaagccatgtacagagatgttgttgcagctctagcagaggcacaggacatccatgtgcacctgataccgctccagcgccacctggaagctctggagaatgcagaatttccggaggtgaagccccagctgcggcccctgctccacgtggtctgtctgatttgggccacatgcaagtcctaccgctccccgggaaggctgactgtgctgctccaggagatttgcaaccttctcatccagcaggcctctaattatctcagcccagaagacctgctgagaagtgaggtagaagaaagtcagagaaaactgcaagtggtctcagacactttgagcttcttcaagcaagagtttcaggacagaagggagaatctccacacttacttcaaagagaaccaggaagtcaaggaatgggatttccagtcttctttggtctttgtgcgattggatggcttcctgggacaactgcacgtggtggagggtcttctgaagacggccctggatttccacaaactgggaaaggtggagttcagcggcgtcagagggaatgctctgagtcagcaggtccagcaaatgcatgaagaatttcaagagatgtacaggcttctctcaggatcctcctccgactgcctgtacctccaaagcacggactttgaaaatgacgtctctgaatttaaccagaaagtagaagatcttgaccgaagattggggactatctttattcaagcttttgatgatgcacctggcttggagcatgcctttaagctgctagacatagcaggaaacctccttgaaagaccgctggtagcgagggatacatctgataaatacctggtcctcatccaaatgttcaacaaagatctggatgcagtgaggatgatctacagtcagcacgtccaggaggaagcagaacttgggttctccccggtgcacaagaacatgcccaccgtggctggcggcctccgctgggcacaggagctgaggcagcgcatccagggtcctttcagcaactttggacgcatcacacacccttgcatggaatctgcagaaggaaagcgaatgcaacaaaaatatgaagatatgctgtcattgctagaaaagtatgagacaagactttatgaggattggtgccggacagtatcagagaagtcacagtacaatctttcccaaccacttctaaaacgtgacccagagacgaaggagatcactatcaactttaacccacagctgatttcagtgctgaaagaaatgagctatcttgaacccagagagatgaaacacatgcctgagacagcagcagccatgttctcctccagggatttctatcggcagcttgtggctaatttagagttgatggcaaattggtacaacaaggttatgaaaactctgctggaggtggaatttccattagtggaggaagagctgcaaaatattgatctccgcctcagagcagcagaggagactttgaactggaaaacagaaggcatttgcgattatgtcactgaaatcaccagtagtattcatgatcttgaacaaagaattcagaaaactaaagacaatgtggaagagatccaaaacatcatgaaaacatgggtgactccaatatttaagacaaaagatggaaaaagggaatcccttctttctctggatgatcggcatgatcgaatggaaaaatattacaatctcatcaaggaatctggccttaagatccacgcccttgttcaggaaaacctgggtctattttcagcagacccaacctccaatatctggaagacttatgttaactctattgacaatttgttgctgaatggattctttcttgccattgagtgctccctcaagtatcttctggaaaatactgagtgtaaggcaggacttaccccaatatttgaagcacaactgagtctagccatcccagagctagttttctatccgtctctggagtctggagtgaaggggggtttctgtgacattgttgagggtctcatcaccagcatttttaggataccatctctggtgccacggctttccccacaaaatggctctcctcactatcaggtcgacctggacggtataccagatttggcaaacatgcggcgcacactcatggagagagtccagagaatgatgggcctctgctgtggctatcagagcaccttcagccagtattcgtacctctatgtggaggaccggaaggaggttctgggtcagtttctgctgtacgggcacatcctcactccggaagaaattgaagaccatgtggaagatggcatcccagagaaccctcccctcctttctcagtttaaagtgcaaatcgactcctatgaaacgctctatgaagaggtgtgcaggctggaacccatcaaggtgtttgacggctggatgaaaattgatattcgaccctttaaggcatctctgctgaatattattaagaggtggagcctcctgttcaaacagcatcttgtggaccacgtcactcacagcttggccaacctggatgcgtttataaagaagagtgagagcggcttactcaagaaagttgaaaaaggagatttccaaggcttggttgagatcatgggacaccttatggctgttaaagaacggcagagtaacactgatgagatgtttgagcccttaaagcagactattgaattgctgaagacctatgaacaagaattgccagaaacagtgtttaagcagctggaggagctgcctgagaaatggaacaacataaaaaaggtggccattactgtgaagcagcaggtggccccactgcaggcaaatgaagtgacactcctccgccagaggtgcacagccttcgatgcagaacagcagcaattctgggagcaattccacaaagaagccccgttcaggtttgatagcatccaccctcatcaaatgctggatgccaggcacatcgagatccagcagatggaatccactatggcctccatttctgagtctgccagcttatttgaagtcaatgtccctgactataagcagctgaggcagtgcaggaaggaggtctgccagctgaaggagctctgggacaccattggaatggtgacctccagcatccatgcctgggagaccacaccctggaggaatatcaacgtggaagccatggagttggagtgcaaacagtttgcccggcatatccgaaacctggacaaggaggtcagggcctgggatgcattcacaggcctggaaagcactgtgtggaacacgctgagctccctgagggcagtagctgagctgcagaatccagccatccgggagcggcactggaggcagctgatgcaggccaccggtgtgagcttcactatggaccaggacaccaccctagcgcacctgctgcagctccagctgcaccactatgaggatgaggtccggggcattgtggacaaagctgcaaaagagatgggtatggagaaaaccttaaaggagctgcagactacctgggctggcatggaattccagtatgagccccacccacggaccaatgtccccctcctgtgctctgatgaggacctcatagaggttctggaggataatcaagttcaacttcagaacctggtgatgtccaagtatgttgctttcttcttggaggaggtgtcgggctggcagaagaagctgtccacagtggacgctgtcatctctatctggtttgaagtgcagcgaacatggactcacctggaaagcatattcactggatctgaagatattcgggcacagctaccccaggattctaaaaggtttgaaggcatcgacattgactttaaagagctagcttatgatgcccagaaaattccaaatgtagtgcaaaccaccaacaagccaggcctgtatgaaaagctggaggatattcagggcagattgtgcctgtgtgagaaggccctggcagagtacctcgacaccaagaggcttgccttcccgcggttttactttctctcctcctccgatctgttagacatcctttccaacggcacagctccacaacaggttcaacgtcacctttccaaactctttgacaacatggccaagatgcgattccagctagatgccagtggggaaccaaccaagacaagcctcggcatgtacagcaaagaagaggagtatgtggctttcagtgagccctgtgactgcagcgggcaggtagaaatatggctgaaccatgtccttggtcacatgaaggccactgtgaggcatgagatgacagaaggtgtaactgcctatgaagaaaagccgagggagcagtggctttttgaccacccagctcaggtggccctgacctgtactcagatctggtggacaacagaagtgggcatggcatttgccaggctggaggaaggctatgagagtgccatgaaggactattataagaagcaagtggcccagctcaaaacccttatcaccatgctgattggccagctctccaagggagaccggcagaagattatgactatatgcaccatcgatgtgcatgcccgggatgtggtagccaagatgattgctcagaaggtagacaatgcccaggctttcctctggctgtctcagctgcgccatcgttgggatgacgaggtcaaacactgctttgccaacatctgtgatgcccagtttttgtattcctatgagtacctgggaaacacacctcgcttggtgatcacacctttgactgacaggtgctacatcaccctcacccagtccctgcacctgaccatgagtggggctcccgcaggacctgcaggcacaggcaagaccgagaccaccaaggacctgggccgcgcactgggcatcctggtctatgtgttcaactgctcggagcagatggattacaagtcttgtggcaacatctacaaaggccttgctcagactggtgcctggggctgctttgatgagtttaatcgaatctccgtggaggtcttgtcagtggtggcagtgcaggtaaaaagcattcaagatgcgattagagataagaagcagtggttcagcttccttggggaggagatcagcctgaatccttctgtcggtatcttcatcaccatgaacccaggctatgctggccgcacagagctgccagagaatctcaagtctctcttcaggccttgtgcaatggtggttccagactttgaattgatctgtgaaatcatgctggtggcagaaggattcattgaagcccagtcattagccagaaagttcatcactctttaccagttgtgcaaagagcttctctccaaacaggatcactacgactggggcctacgggccatcaagtccgtgctggtggtggcaggatccctgaagagaggagaccctgaccggcctgaggaccaggtcctgatgcgctccttgcgggatttcaacatccccaagattgtgactgatgacatgcccatcttcatgggcctgatcggggacctctttcccgccctggatgtcccccggaggagagaccccaacttcgaagctttggttaggaaggcgatagtggatctgaagctccaggctgaggacaactttgtgctcaaggtggtccagctggaggagctcctggctgtgcggcactctgtatttgtggtgggtggcgctggtaccggcaagtcacaggtgctgaggtccttgcacaagacctatcagatcatgaaacggcgccccgtctggactgacctcaatcccaaagcagtcacaaatgatgagctctttggcatcatcaatccagccacaggagaatggaaggatggattgttctcttccatcatgcgggagcttgccaacatcacccatgatgggcccaagtggattttactggatggcgacatagatccaatgtggattgaatccctgaatactgtcatggatgataacaaggtgctgacattggccagcaatgagaggattcctctgaaccccaccatgaagctcctctttgagatcagccacctgcgcacagccactccagcaactgtctctagagcagggatcttgtacatcaacccggcagacttgggatggaaccctccagtgagcagctggattgagaagagggaaatccagacagagagagccaacttaaccattttgttcgacaagtatcttccaacctgcctagacacactcagaaccaggtttaagaagatcattcccatcccagagcagagcatggttcagatggtgtgtcaccttctggaatgtctcctgaccacggaggacatccctgcagactgccctaaggaaatttatgagcattattttgtgtttgctgccatctgggctttcggcggagcaatggtccaagatcagcttgtggactaccgggcagagttcagcaaatggtggctgactgagttcaaaacagtcaagtttccttcccaaggaaccatctttgactattacatcgacccagagaccaagaaattcgagccttggtccaagctcgtcccccagttcgaatttgaccccgagatgcccttgcaggcgtgtttggtgcacacgagtgagaccatccgtgtgtgctacttcatggagcggttgatggcgcggcagcggcctgtcatgctggtgggcacggctggcactggcaagtcggtgctggtgggagctaagctggccagccttgaccccgaggcatacctggtgaaaaacgtgccattcaactactacaccacgtcagcaatgctgcaggctgtcctggagaagcctctggaaaagaaggctggcagaaactatggccctccagggaacaagaaactcatctatttcattgatgacatgaacatgcctgaggtggatgcctacgggacggtgcagccccacaccatcatccggcagcatctggactatggccactggtatgatcggagcaagctgtccctaaaggagatcacaaatgtacagtatgtttcctgtatgaaccccacggcaggcagcttcaccatcaacccccggcttcagcgtcacttcagcgtgtttgtcctctccttcccgggggcagatgccctgtcctctatctacagcatcatcctcactcagcatctgaagctcggaaacttcccggcgtccctgcagaaatccatccccccactgatcgatctggccctcgccttccaccagaaaattgctaccaccttcctacccacaggaatcaaattccactacatcttcaacctcagagattttgccaacattttccagggcattctcttctcctcagtggaatgtgtgaaatccacatgggatcttataaggctctatctgcatgaatcaaatcgagtttatcgggataagatggtagaagaaaaggactttgatctttttgataaaatccagacagaagtgctcaagaaaacttttgatgatattgaagaccctgtggagcagacccaaagcccgaacctgtattgtcactttgcaaatggtattggggagcccaaatacatgcctgtacagtcttgggaacttttgacccagactctggtggaggccttggagaaccacaatgaagtcaacacagtgatggacctagttctctttgaggatgccatgcgccatgtctgccatatcaatcgcatcttggagtccccgcggggaaatgctctgctggttggtgtaggtgggagcggcaagcagagcctgacaaggctggcagctttcatcagctccatggatgtcttccagatcacactgcgcaaaggctaccagatccaggacttcaagatggacctggccagcctgtgtctgaaagctggagtgaagaatctcaacacagtgtttctcatgactgatgcccaagtggctgatgagaggttccttgtgctcatcaatgatcttttggcatctggggagatcccagatctctactctgatgatgaagttgaaaacatcataagcaatgtgaggaatgaagtcaagagccagggtctggttgacaacagagagaactgttggaagttctttatagatcggatccggcgacagctgaaggtgactctctgtttctcccctgtgggaaacaagctaagagtccgcagcaggaagttcccagccattgtgaactgcacagccatccactggttccacgagtggcctcagcaagcattggagtctgtcagcctccgcttcttgcagaacacagagggcattgagcccacagtaaagcagtcgattagcaaattcatggcctttgtccacacaagtgtcaaccaaacatcccagtcttatctgagcaatgaacagcgctacaactatacaactcccaagtcctttctggagttcatcagactctaccagagcttgttgcacaggcacagaaaagagctcaagtgcaagacagagcggttggagaacgggctgctgaagctgcatagcacctctgcccaggtggatgatctgaaagcaaagctggctgcccaggaagtagagctgaagcagaaaaatgaagatgcagacaaactgattcaggtcgtgggtgtggagactgacaaagtgagcagagagaaagccatggcagatgaagaggagcagaaggtggccgtcatcatgctagaggtgaaacagaagcagaaggactgtgaggaggacctggcaaaggctgagccagcactcacagcagcgcaggcagctctcaacaccctgaacaagaccaacctgacagagctgaagtcatttggctctccgcctctggccgtcagcaatgtcagcgctgcggtgatggtactgatggctcccaggggtagggtgcccaaggaccggagctggaaggctgctaaggtcaccatggccaaagtggatggcttcctggactcgctaataaacttcaacaaagagaacattcacgagaactgcctcaaagccatcaggccgtatctgcaagaccccgagttcaatcctgagtttgtggccaccaaatcctatgcggctgcaggcctctgctcctgggtcatcaatattgtgagattttatgaggtgttctgtgatgtggaacccaagcgccaggcactgaacaaagccaccgcggacctcacagctgcccaggagaagctggctgccatcaaagccaagatcgctcaccttaatgaaaacctggcaaagctcacagccaggtttgagaaagcaacagcagacaaactcaaatgtcagcaagaagccgaagtgaccgcagtcaccatctcccttgccaaccgcctggttggaggactcgcttctgaaaacgtgaggtgggcagatgccgtgcagaacttcaaacagcaggaaaggacgttatgtggagacattttacttataacggctttcatttcctaccttggcttcttcacaaagaaataccggcagagcctcctggacagaacttggaggccctacctgagccagctgaaaactcccattccagtcaccccagccctggatcccctgaggatgctgatggatgatgctgacgtggctgcctggcagaacgagggcctcccagccgaccgcatgtccgtggagaatgccaccattctcatcaactgtgagcgctggccactcatggttgaccctcagctacaaggcatcaaatggatcaagaataaatatggtgaagatctccgggtcacgcagattggtcagaaaggctaccttcaaatcatagagcaggccctggaagctggagctgtggtgctgattgaaaatctagaggagtccattgatcctgttctgggacccctgcttgggagagaagtcattaaaaaaggacgattcattaaaattggagacaaagaatgtgaatacaatcccaagttccggctcatcctccacaccaagctggctaatcctcactaccagcctgagctgcaggctcaggccaccctgatcaacttcaccgtgaccagggatggcctggaggaccagttgctggccgctgtggtcagcatggagaggccagacttggagcagctgaagtccgatctcacaaagcagcagaatggattcaaaattaccctgaaaacgttggaagacagtcttctctctcgcctctcctccgcctctgggaacttcctgggagaaacagtgctggtggaaaacctagagatcaccaagcagactgctgccgaagttgagaaaaaggtccaggaggccaaggtgactgaagtgaaaatcaacgaggcccgagagcactaccggccagcagctgccagggcctcactgctctacttcatcatgaacgacctcagcaagatccatccaatgtaccagttttctctcaaggccttcagtatcgtcttccagaaggctgtggagagggctgctcctgacgaaagcctcagggagcgggtggccaacctaatagacagcataaccttctctgtgtaccagtacaccatccgcgggctctttgagtgtgataagctgacctaccttgcccagctcacctttcagattctcctcatgaaccgagaagtcaatgcagtggagttggatttcctgcttcgatctccagtgcagacgggcaccgccagccccgtggagttcctctcccatcaggcgtggggagctgtcaaggtactttcatcaatggaagaattctctaatctggatcgggacatagagggatctgctaagagctggaaaaagtttgtggagtccgaatgtcctgagaaagagaagctcccacaggagtggaagaacaagacagccctgcagcgcctctgcatgctgagagccatgcggcccgaccggatgacctatgctttgcgagattttgttgaagagaagttaggaagcaaatacgtggtgggaagagccctagattttgcaacctcatttgaagaatcgggaccagccactcctatgtttttcatcctgtctccaggggtggacccactgaaggatgtagaaagtcaaggaagaaaacttggatacaccttcaacaatcagaactttcacaacgtgtctttggggcaaggacaggaagtggtggctgaggctgcgctggacctcgctgccaagaaaggtcactgggttattttgcagaacattcacctggtggccaagtggctcagcaccctggagaagaagctggaggagcacagtgagaacagccacccagagttcagggtcttcatgagtgcagagccagcaccctcccctgagggccacatcatcccccagggcatcctggagaactccattaagatcaccaatgagccccccacgggcatgcatgccaacctgcacaaggccctggacaacttcactcaggacactctggagatgtgttctcgggagacggagtttaagagcatcctctttgctctttgttacttccatgcggtggtggcagaaagacgaaaatttgggccccagggatggaatcgctcatacccctttaacactggagacctcactatctctgtgaatgtcctctacaacttcctggaggccaacgcaaaggtcccctatgatgatttgcgctacctgtttggagagatcatgtatggaggccatatcacagatgactgggacagaagactctgcagaacctacctgggggaattcattcgaccagaaatgttagaaggagaactgtctttggccccagggttcccactcccaggcaacatggactacaatggttatcatcagtacatcgatgctgagctgcccccagaatccccctacctctatggcctccacccgaacgcagagattggcttcctgacccaaacctcagaaaagctcttccgcactgtgctggagctgcagcctcgggacagccaggccagagacggagcgggcgccacaagagaagaaaaggtcaaggcacttctggaagaaatattggagcgggtgacagacgagtttaacatcccagaactgatggccaaagtggaggagcgcaccccttacattgtagttgccttccaggagtgtggccggatgaatatcctcaccagagagattcagcgctcactgagggagctggagctcggcttaaagggggagctgactatgaccagccacatggagaacttacagaatgccctgtacttcgatatggtgccagagtcctgggctagacgagcctacccttccacagcaggcctggcagcctggtttccagacctcctcaacagaatcaaggagctagaggcttggacgggtgactttacaatgccctccactgtgtggctgacaggcttcttcaacccccagtcgttcctgactgccatcatgcagtccacggctcgcaagaatgagtggccactggaccagatggccctgcaatgtgacatgacgaagaagaacagagaagagtttaggagtcctcctcgggaaggggcctacatccatggcctcttcatggaaggtgcctgctgggacacacaggctgggatcattacagaggcaaagctgaaggatctgacaccccctatgcctgtgatgttcatcaaggccattcctgcagataagcaggactgccgcagtgtctattcctgtcctgtgtacaagactagtcagcggggacccacctacgtgtggactttcaacctgaagactaaggaaaacccatccaagtgggttctggctggagtagccttgcttctccagatttagcatcctgcagagccaccgagaaaataaaaaagctgggcttggaggctgcctagagggacaggtgggtgaagggtcaccacagacacttagaacggtaagaaaccatgagcactcacaattctgtagaattcctctagggaacttggagaggtgtgcctaaggtgaggctgagctgaaggaatgtgggcccaggtttcttaataaaatgatttactcttcaa

SEQ ID NO: 128549 - DNA, 13452 bp, Homo sapiens
  Payload ID: 5162
  Gene Symbol: DNAH9
  Gene Name: dynein, axonemal, heavy chain 9
  ENST ID: ENST00000454412
  CDS Start-End: 1-13233
atgcggctcgcggaggagcgggccgcgctcgcggcggagaacgcggatggggaacccggcgccgaccgacgactgcgactcctggggacctacgtggccatgagcctgcggccggctgcgggcgcctgggagcgttgcgcggggagtgctgaggcggagcagctgctccaggccttcctgggccgcgatgctgccgaggggccgcggccgctgctggtggtgcggcccgggcccaggggcctggcaatacgccccgggctggaggtgggacctgagtcgggcctggctggcgctaaggcgctttttttccttcgcaccgggcccgagcctccagggcccgacagcttccgcggcgcagtggtctgcggggacctgcccgcggcacctctggagcacctagccgcgctgttctcggaggttgttctacccgtcctggccaatgagaagaatcgcctaaactggccccacatgatatgtgaggatgtcaggcggcacgcccacagcctccaatgtgacctctcagttatacttgagcaagtgaagggaaaaactttgctgcctcttccagcaggctcagaaaaaatggagtttgcggattccaaaagtgagacagtcttggattctatagataagtcagtcatctatgccattgagtctgcagtgatcaaatggagctaccaagtccaggtggtactcaagagagagtcttcccagccactcttacaaggggagaatcccacccctaaggtggagttggagttctggaagagcaggtatgaagatctgaaatacatctataatcaactgagaacaataacggtgaggggcatggccaagctcctggacaagcttcagagtagctactttccagctttcaaagccatgtacagagatgttgttgcagctctagcagaggcacaggacatccatgtgcacctgataccgctccagcgccacctggaagctctggagaatgcagaatttccggaggtgaagccccagctgcggcccctgctccacgtggtctgtctgatttgggccacatgcaagtcctaccgctccccgggaaggctgactgtgctgctccaggagatttgcaaccttctcatccagcaggcctctaattatctcagcccagaagacctgctgagaagtgaggtagaagaaagtcagagaaaactgcaagtggtctcagacactttgagcttcttcaagcaagagtttcaggacagaagggagaatctccacacttacttcaaagagaaccaggaagtcaaggaatgggatttccagtcttctttggtctttgtgcgattggatggcttcctgggacaactgcacgtggtggagggtcttctgaagacggccctggatttccacaaactgggaaaggtggagttcagcggcgtcagagggaatgctctgagtcagcaggtccagcaaatgcatgaagaatttcaagagatgtacaggcttctctcaggatcctcctccgactgcctgtacctccaaagcacggactttgaaaatgacgtctctgaatttaaccagaaagtagaagatcttgaccgaagattggggactatctttattcaagcttttgatgatgcacctggcttggagcatgcctttaagctgctagacatagcaggaaacctccttgaaagaccgctggtagcgagggatacatctgataaatacctggtcctcatccaaatgttcaacaaagatctggatgcagtgaggatgatctacagtcagcacgtccaggaggaagcagaacttgggttctccccggtgcacaagaacatgcccaccgtggctggcggcctccgctgggcacaggagctgaggcagcgcatccagggtcctttcagcaactttggacgcatcacacacccttgcatggaatctgcagaaggaaagcgaatgcaacaaaaatatgaagatatgctgtcattgctagaaaagtatgagacaagactttatgaggattggtgccggacagtatcagagaagtcacagtacaatctttcccaaccacttctaaaacgtgacccagagacgaaggagatcactatcaactttaacccacagctgatttcagtgctgaaagaaatgagctatcttgaacccagagagatgaaacacatgcctgagacagcagcagccatgttctcctccagggatttctatcggcagcttgtggctaatttagagttgatggcaaattggtacaacaaggttatgaaaactctgctggaggtggaatttccattagtggaggaagagctgcaaaatattgatctccgcctcagagcagcagaggagactttgaactggaaaacagaaggcatttgcgattatgtcactgaaatcaccagtagtattcatgatcttgaacaaagaattcagaaaactaaagacaatgtggaagagatccaaaacatcatgaaaacatgggtgactccaatatttaagacaaaagatggaaaaagggaatcccttctttctctggatgatcggcatgatcgaatggaaaaatattacaatctcatcaaggaatctggccttaagatccacgcccttgttcaggaaaacctgggtctattttcagcagacccaacctccaatatctggaagacttatgttaactctattgacaatttgttgctgaatggattctttcttgccattgagtgctccctcaagtatcttctggaaaatactgagtgtaaggcaggacttaccccaatatttgaagcacaactgagtctagccatcccagagctagttttctatccgtctctggagtctggagtgaaggggggtttctgtgacattgttgagggtctcatcaccagcatttttaggataccatctctggtgccacggctttccccacaaaatggctctcctcactatcaggtcgacctggacggtataccagatttggcaaacatgcggcgcacactcatggagagagtccagagaatgatgggcctctgctgtggctatcagagcaccttcagccagtattcgtacctctatgtggaggaccggaaggaggttctgggtcagtttctgctgtacgggcacatcctcactccggaagaaattgaagaccatgtggaagatggcatcccagagaaccctcccctcctttctcagtttaaagtgcaaatcgactcctatgaaacgctctatgaagaggtgtgcaggctggaacccatcaaggtgtttgacggctggatgaaaattgatattcgaccctttaaggcatctctgctgaatattattaagaggtggagcctcctgttcaaacagcatcttgtggaccacgtcactcacagcttggccaacctggatgcgtttataaagaagagtgagagcggcttactcaagaaagttgaaaaaggagatttccaaggcttggttgagatcatgggacaccttatggctgttaaagaacggcagagtaacactgatgagatgtttgagcccttaaagcagactattgaattgctgaagacctatgaacaagaattgccagaaacagtgtttaagcagctggaggagctgcctgagaaatggaacaacataaaaaaggtggccattactgtgaagcagcaggtggccccactgcaggcaaatgaagtgacactcctccgccagaggtgcacagccttcgatgcagaacagcagcaattctgggagcaattccacaaagaagccccgttcaggtttgatagcatccaccctcatcaaatgctggatgccaggcacatcgagatccagcagatggaatccactatggcctccatttctgagtctgccagcttatttgaagtcaatgtccctgactataagcagctgaggcagtgcaggaaggaggtctgccagctgaaggagctctgggacaccattggaatggtgacctccagcatccatgcctgggagaccacaccctggaggaatatcaacgtggaagccatggagttggagtgcaaacagtttgcccggcatatccgaaacctggacaaggaggtcagggcctgggatgcattcacaggcctggaaagcactgtgtggaacacgctgagctccctgagggcagtagctgagctgcagaatccagccatccgggagcggcactggaggcagctgatgcaggccaccggtgtgagcttcactatggaccaggacaccaccctagcgcacctgctgcagctccagctgcaccactatgaggatgaggtccggggcattgtggacaaagctgcaaaagagatgggtatggagaaaaccttaaaggagctgcagactacctgggctggcatggaattccagtatgagccccacccacggaccaatgtccccctcctgtgctctgatgaggacctcatagaggttctggaggataatcaagttcaacttcagaacctggtgatgtccaagtatgttgctttcttcttggaggaggtgtcgggctggcagaagaagctgtccacagtggacgctgtcatctctatctggtttgaagtgcagcgaacatggactcacctggaaagcatattcactggatctgaagatattcgggcacagctaccccaggattctaaaaggtttgaaggcatcgacattgactttaaagagctagcttatgatgcccagaaaattccaaatgtagtgcaaaccaccaacaagccaggcctgtatgaaaagctggaggatattcagggcagattgtgcctgtgtgagaaggccctggcagagtacctcgacaccaagaggcttgccttcccgcggttttactttctctcctcctccgatctgttagacatcctttccaacggcacagctccacaacaggttcaacgtcacctttccaaactctttgacaacatggccaagatgcgattccagctagatgccagtggggaaccaaccaagacaagcctcggcatgtacagcaaagaagaggagtatgtggctttcagtgagccctgtgactgcagcgggcaggtagaaatatggctgaaccatgtccttggtcacatgaaggccactgtgaggcatgagatgacagaaggtgtaactgcctatgaagaaaagccgagggagcagtggctttttgaccacccagctcaggtggccctgacctgtactcagatctggtggacaacagaagtgggcatggcatttgccaggctggaggaaggctatgagagtgccatgaaggactattataagaagcaagtggcccagctcaaaacccttatcaccatgctgattggccagctctccaagggagaccggcagaagattatgactatatgcaccatcgatgtgcatgcccgggatgtggtagccaagatgattgctcagaaggtagacaatgcccaggctttcctctggctgtctcagctgcgccatcgttgggatgacgaggtcaaacactgctttgccaacatctgtgatgcccagtttttgtattcctatgagtacctgggaaacacacctcgcttggtgatcacacctttgactgacaggtgctacatcaccctcacccagtccctgcacctgaccatgagtggggctcccgcaggacctgcaggcacaggcaagaccgagaccaccaaggacctgggccgcgcactgggcatcctggtctatgtgttcaactgctcggagcagatggattacaagtcttgtggcaacatctacaaaggccttgctcagactggtgcctggggctgctttgatgagtttaatcgaatctccgtggaggtcttgtcagtggtggcagtgcaggtaaaaagcattcaagatgcgattagagataagaagcagtggttcagcttccttggggaggagatcagcctgaatccttctgtcggtatcttcatcaccatgaacccaggctatgctggccgcacagagctgccagagaatctcaagtctctcttcaggccttgtgcaatggtggttccagactttgaattgatctgtgaaatcatgctggtggcagaaggattcattgaagcccagtcattagccagaaagttcatcactctttaccagttgtgcaaagagcttctctccaaacaggatcactacgactggggcctacgggccatcaagtccgtgctggtggtggcaggatccctgaagagaggagaccctgaccggcctgaggaccaggtcctgatgcgctccttgcgggatttcaacatccccaagattgtgactgatgacatgcccatcttcatgggcctgatcggggacctctttcccgccctggatgtcccccggaggagagaccccaacttcgaagctttggttaggaaggcgatagtggatctgaagctccaggctgaggacaactttgtgctcaaggtggtccagctggaggagctcctggctgtgcggcactctgtatttgtggtgggtggcgctggtaccggcaagtcacaggtgctgaggtccttgcacaagacctatcagatcatgaaacggcgccccgtctggactgacctcaatcccaaagcagtcacaaatgatgagctctttggcatcatcaatccagccacaggagaatggaaggatggattgttctcttccatcatgcgggagcttgccaacatcacccatgatgggcccaagtggattttactggatggcgacatagatccaatgtggattgaatccctgaatactgtcatggatgataacaaggtgctgacattggccagcaatgagaggattcctctgaaccccaccatgaagctcctctttgagatcagccacctgcgcacagccactccagcaactgtctctagagcagggatcttgtacatcaacccggcagacttgggatggaaccctccagtgagcagctggattgagaagagggaaatccagacagagagagccaacttaaccattttgttcgacaagtatcttccaacctgcctagacacactcagaaccaggtttaagaagatcattcccatcccagagcagagcatggttcagatggtgtgtcaccttctggaatgtctcctgaccacggaggacatccctgcagactgccctaaggaaatttatgagcattattttgtgtttgctgccatctgggctttcggcggagcaatggtccaagatcagcttgtggactaccgggcagagttcagcaaatggtggctgactgagttcaaaacagtcaagtttccttcccaaggaaccatctttgactattacatcgacccagagaccaagaaattcgagccttggtccaagctcgtcccccagttcgaatttgaccccgagatgcccttgcaggcgtgtttggtgcacacgagtgagaccatccgtgtgtgctacttcatggagcggttgatggcgcggcagcggcctgtcatgctggtgggcacggctggcactggcaagtcggtgctggtgggagctaagctggccagccttgaccccgaggcatacctggtgaaaaacgtgccattcaactactacaccacgtcagcaatgctgcaggctgtcctggagaagcctctggaaaagaaggctggcagaaactatggccctccagggaacaagaaactcatctatttcattgatgacatgaacatgcctgaggtggatgcctacgggacggtgcagccccacaccatcatccggcagcatctggactatggccactggtatgatcggagcaagctgtccctaaaggagatcacaaatgtacagtatgtttcctgtatgaaccccacggcaggcagcttcaccatcaacccccggcttcagcgtcacttcagcgtgtttgtcctctccttcccgggggcagatgccctgtcctctatctacagcatcatcctcactcagcatctgaagctcggaaacttcccggcgtccctgcagaaatccatccccccactgatcgatctggccctcgccttccaccagaaaattgctaccaccttcctacccacaggaatcaaattccactacatcttcaacctcagagattttgccaacattttccagggcattctcttctcctcagtggaatgtgtgaaatccacatgggatcttataaggctctatctgcatgaatcaaatcgagtttatcgggataagatggtagaagaaaaggactttgatctttttgataaaatccagacagaagtgctcaagaaaacttttgatgatattgaagaccctgtggagcagacccaaagcccgaacctgtattgtcactttgcaaatggtattggggagcccaaatacatgcctgtacagtcttgggaacttttgacccagactctggtggaggccttggagaaccacaatgaagtcaacacagtgatggacctagttctctttgaggatgccatgcgccatgtctgccatatcaatcgcatcttggagtccccgcggggaaatgctctgctggttggtgtaggtgggagcggcaagcagagcctgacaaggctggcagctttcatcagctccatggatgtcttccagatcacactgcgcaaaggctaccagatccaggacttcaagatggacctggccagcctgtgtctgaaagctggagtgaagaatctcaacacagtgtttctcatgactgatgcccaagtggctgatgagaggttccttgtgctcatcaatgatcttttggcatctggggagatcccagatctctactctgatgatgaagttgaaaacatcataagcaatgtgaggaatgaagtcaagagccagggtctggttgacaacagagagaactgttggaagttctttatagatcggatccggcgacagctgaaggtgactctctgtttctcccctgtgggaaacaagctaagagtccgcagcaggaagttcccagccattgtgaactgcacagccatccactggttccacgagtggcctcagcaagcattggagtctgtcagcctccgcttcttgcagaacacagagggcattgagcccacagtaaagcagtcgattagcaaattcatggcctttgtccacacaagtgtcaaccaaacatcccagtcttatctgagcaatgaacagcgctacaactatacaactcccaagtcctttctggagttcatcagactctaccagagcttgttgcacaggcacagaaaagagctcaagtgcaagacagagcggttggagaacgggctgctgaagctgcatagcacctctgcccaggtggatgatctgaaagcaaagctggctgcccaggaagtagagctgaagcagaaaaatgaagatgcagacaaactgattcaggtcgtgggtgtggagactgacaaagtgagcagagagaaagccatggcagatgaagaggagcagaaggtggccgtcatcatgctagaggtgaaacagaagcagaaggactgtgaggaggacctggcaaaggctgagccagcactcacagcagcgcaggcagctctcaacaccctgaacaagaccaacctgacagagctgaagtcatttggctctccgcctctggccgtcagcaatgtcagcgctgcggtgatggtactgatggctcccaggggtagggtgcccaaggaccggagctggaaggctgctaaggtcaccatggccaaagtggatggcttcctggactcgctaataaacttcaacaaagagaacattcacgagaactgcctcaaagccatcaggccgtatctgcaagaccccgagttcaatcctgagtttgtggccaccaaatcctatgcggctgcaggcctctgctcctgggtcatcaatattgtgagattttatgaggtgttctgtgatgtggaacccaagcgccaggcactgaacaaagccaccgcggacctcacagctgcccaggagaagctggctgccatcaaagccaagatcgctcaccttaatgaaaacctggcaaagctcacagccaggtttgagaaagcaacagcagacaaactcaaatgtcagcaagaagccgaagtgaccgcagtcaccatctcccttgccaaccgcctggttggaggactcgcttctgaaaacgtgaggtgggcagatgccgtgcagaacttcaaacagcaggaaaggacgttatgtggagacattttacttataacggctttcatttcctaccttggcttcttcacaaagaaataccggcagagcctcctggacagaacttggaggccctacctgagccagctgaaaactcccattccagtcaccccagccctggatcccctgaggatgctgatggatgatgctgacgtggctgcctggcagaacgagggcctcccagccgaccgcatgtccgtggagaatgccaccattctcatcaactgtgagcgctggccactcatggttgaccctcagctacaaggcatcaaatggatcaagaataaatatggtgaagatctccgggtcacgcagattggtcagaaaggctaccttcaaatcatagagcaggccctggaagctggagctgtggtgctgattgaaaatctagaggagtccattgatcctgttctgggacccctgcttgggagagaagtcattaaaaaaggacgattcattaaaattggagacaaagaatgtgaatacaatcccaagttccggctcatcctccacaccaagctggctaatcctcactaccagcctgagctgcaggctcaggccaccctgatcaacttcaccgtgaccagggatggcctggaggaccagttgctggccgctgtggtcagcatggagaggccagacttggagcagctgaagtccgatctcacaaagcagcagaatggattcaaaattaccctgaaaacgttggaagacagtcttctctctcgcctctcctccgcctctgggaacttcctgggagaaacagtgctggtggaaaacctagagatcaccaagcagactgctgccgaagttgagaaaaaggtccaggaggccaaggtgactgaagtgaaaatcaacgaggcccgagagcactaccggccagcagctgccagggcctcactgctctacttcatcatgaacgacctcagcaagatccatccaatgtaccagttttctctcaaggccttcagtatcgtcttccagaaggctgtggagagggctgctcctgacgaaagcctcagggagcgggtggccaacctaatagacagcataaccttctctgtgtaccagtacaccatccgcgggctctttgagtgtgataagctgacctaccttgcccagctcacctttcagattctcctcatgaaccgagaagtcaatgcagtggagttggatttcctgcttcgatctccagtgcagacgggcaccgccagccccgtggagttcctctcccatcaggcgtggggagctgtcaaggtactttcatcaatggaagaattctctaatctggatcgggacatagagggatctgctaagagctggaaaaagtttgtggagtccgaatgtcctgagaaagagaagctcccacaggagtggaagaacaagacagccctgcagcgcctctgcatgctgagagccatgcggcccgaccggatgacctatgctttgcgagattttgttgaagagaagttaggaagcaaatacgtggtgggaagagccctagattttgcaacctcatttgaagaatcgggaccagccactcctatgtttttcatcctgtctccaggggtggacccactgaaggatgtagaaagtcaaggaagaaaacttggatacaccttcaacaatcagaactttcacaacgtgtctttggggcaaggacaggaagtggtggctgaggctgcgctggacctcgctgccaagaaaggtcactgggttattttgcaggacactctggagatgtgttctcgggagacggagtttaagagcatcctctttgctctttgttacttccatgcggtggtggcagaaagacgaaaatttgggccccagggatggaatcgctcatacccctttaacactggagacctcactatctctgtgaatgtcctctacaacttcctggaggccaacgcaaaggtcccctatgatgatttgcgctacctgtttggagagatcatgtatggaggccatatcacagatgactgggacagaagactctgcagaacctacctgggggaattcattcgaccagaaatgttagaaggagaactgtctttggccccagggttcccactcccaggcaacatggactacaatggttatcatcagtacatcgatgctgagctgcccccagaatccccctacctctatggcctccacccgaacgcagagattggcttcctgacccaaacctcagaaaagctcttccgcactgtgctggagctgcagcctcgggacagccaggccagagacggagcgggcgccacaagagaagaaaaggtcaaggcacttctggaagaaatattggagcgggtgacagacgagtttaacatcccagaactgatggccaaagtggaggagcgcaccccttacattgtagttgccttccaggagtgtggccggatgaatatcctcaccagagagattcagcgctcactgagggagctggagctcggcttaaagggggagctgactatgaccagccacatggagaacttacagaatgccctgtacttcgatatggtgccagagtcctgggctagacgagcctacccttccacagcaggcctggcagcctggtttccagacctcctcaacagaatcaaggagctagaggcttggacgggtgactttacaatgccctccactgtgtggctgacaggcttcttcaacccccagtcgttcctgactgccatcatgcagtccacggctcgcaagaatgagtggccactggaccagatggccctgcaatgtgacatgacgaagaagaacagagaagagtttaggagtcctcctcgggaaggggcctacatccatggcctcttcatggaaggtgcctgctgggacacacaggctgggatcattacagaggcaaagctgaaggatctgacaccccctatgcctgtgatgttcatcaaggccattcctgcagataagcaggactgccgcagtgtctattcctgtcctgtgtacaagactagtcagcggggacccacctacgtgtggactttcaacctgaagactaaggaaaacccatccaagtgggttctggctggagtagccttgcttctccagatttagcatcctgcagagccaccgagaaaataaaaaagctgggcttggaggctgcctagagggacaggtgggtgaagggtcaccacagacacttagaacggtaagaaaccatgagcactcacaattctgtagaattcctctagggaacttggagaggtgtgcctaaggtgaggctgagctgaaggaatgtgggcccaggtttcttaataaaatgatttactcttc

SEQ ID NO: 128550 - DNA, 854 bp, Homo sapiens
  Payload ID: 5162
  Gene Symbol: DNAH9
  Gene Name: dynein, axonemal, heavy chain 9
  ENST ID: ENST00000579703
  CDS Start-End: 1-854
aatgtcagcgctgcggtgatggtactgatggctcccaggggtagggtgcccaaggaccggagctggaaggctgctaaggtcaccatggccaaagtggatggcttcctggactcgctaataaacttcaacaaagagaacattcacgagaactgcctcaaagccatcaggccgtatctgcaagaccccgagttcaatcctgagtttgtggccaccaaatcctatgcggctgcaggcctctgctcctgggtcatcaatattgtgagattttatgaggtgttctgtgatgtggaacccaagcgccaggcactgaacaaagccaccgcggacctcacagctgcccaggagaagctggctgccatcaaagccaagatcgctcaccttaatgaaaacctggcaaagctcacagccaggtttgagaaagcaacagcagacaaactcaaatgtcagcaagaagccgaagtgaccgcagtcaccatctcccttgccaaccgcctgactcccattccagtcaccccagccctggatcccctgaggatgctgatggatgatgctgacgtggctgcctggcagaacgagggcctcccagccgaccgcatgtccgtggagaatgccaccattctcatcaactgtgagcgctggccactcatggttgaccctcagctacaaggcatcaaatggatcaagaataaatatggtgaagatctccgggtcacgcagattggtcagaaaggctaccttcaaatcatagagcaggccctggaagctggagctgtggtgctgattgaaaatctagaggagtccattgatcctgttctgggacccctgcttgggagagaagtcattaaaaaaggacg

SEQ ID NO: 128551 - DNA, 1986 bp, Homo sapiens
  Payload ID: 5162
  Gene Symbol: DNAH9
  Gene Name: dynein, axonemal, heavy chain 9
  ENST ID: ENST00000579828
  CDS Start-End: 30-989
gaaaccgatgcagctggaggccgcgcgcgatgcggctcgcggaggagcgggccgcgctcgcggcggagaacgcggatggggaacccggcgccgaccgacgactgcgactcctggggacctacgtggccatgagcctgcggccggctgcgggcgcctgggagcgttgcgcggggagtgctgaggcggagcagctgctccaggccttcctgggccgcgatgctgccgaggggccgcggccgctgctggtggtgcggcccgggcccaggggcctggcaatacgccccgggctggaggtgggacctgagtcgggcctggctggcgctaaggcgctttttttccttcgcaccgggcccgagcctccagggcccgacagcttccgcggcgcagtggtctgcggggacctgcccgcggcacctctggagcacctagccgcgctgttctcggaggttgttctacccgtcctggccaatgagaagaatcgcctaaactggccccacatgatatgtgaggatgtcaggcggcacgcccacagcctccaatgtgacctctcagttatacttgagcaagtgaagggaaaaactttgctgcctcttccagcaggctcagaaaaaatggagtttgcggattccaaaagtgagacagtcttggattctatagataagtcagtcatctatgccattgagtctgcagtgatcaaatggagctaccaagtccaggtggtactcaagagagagtcttcccagccactcttacaaggggagaatcccacccctaaggtggagttggagttctggaagagcaggtatgaagatctgaaatacatctataatcaactgagaacaataacggtgaggggcatggccaagctcctggacaagcttcagagtagctactttccagctttcaaagccatgtacagagatgttgttgcaggtgaggaccagcaagtgttttcacaaatgtgtttgactcaagttaccgtcgaatgatgcattcacctctctctgtctgaattccgcaacttcaagtccttgtaaatttccgacccgacacaaactagcatggtggcaagaataccacatctagatacatgagagcagctaaacagagctatgctgtttgcagttccactgctgtatggcctgggaaaattcacctagcccctctgagctttagtacgtgtgttggttatggggcatacacttctgcctacttttctaggtccgtgtgagattatacaggtggaagaacttattgacttaacacaacaatgttcctggagctgtccctttgtgtctttcaaacactggggccaggacatacagttctggggtggccattatggagcctgtgtgaccaactccagggtggtcatgtgagtccatctgtcctaatcaaggactacccttctggcaagacagcctaaccatgccttccaggacctgggattattggctgggacccctcattaactaagtgcttgtacctccctggcacgctgggaactcctgggtctggtcaaaggtctttctgggcctgtcttcagggtctggaaactactagaagaaagttcttccatccgatctgcctacagctgctgctttgcactgtacaaatccatgttgttacctctcacctctggaattcaggtccctccacctttggctccttgagaaatctctattccatttctagctccattctgcattttctattcctactgtcagatgggactgcaatttcctggccatttgagcaccagacaagatctacgcttatcaaaattgccaagccagcaaagtctatgattagaagtaggtaaatttttttaggactccctctccatttcttggagcactgtgcgtcttctccctttttcttgtaaaatctcctctttgctcttcagtaccataggtcaaaatgtgcttttaaaggtctttgtcatttcacatggtctaagcttaattaaagcagtgattttcaaac

SEQ ID NO: 128552 - DNA, 429 bp, Homo sapiens
  Payload ID: 5162
  Gene Symbol: DNAH9
  Gene Name: dynein, axonemal, heavy chain 9
  ENST ID: ENST00000579602
  CDS Start-End: 1-264
cccacccctaaggtggagttggagttctggaagagcaggtatgaagatctgaaatacatctataatcaactgagaacaataacggtgaggggcatggccaagctcctggacaagcttcagagtagctactttccagctttcaaagccatgtacagagatgttgttgcagatgggactgcaatttcctggccatttgagcaccagacaagatctacgcttatcaaaattgccaagccagcaaagtctatgattagaagtaggtaaatttttttaggactccctctccatttcttggagcactgtgcgtcttctccctttttcttgtaaaatctcctctttgctcttcagtaccataggtcaaaatgtgcttttaaaggtctttgtcatttcacatggtctaagcttaattaaagcagtgattttcaaaca

SEQ ID NO: 128553 - DNA, 313 bp, Homo sapiens
  Payload ID: 5162
  Gene Symbol: DNAH9
  Gene Name: dynein, axonemal, heavy chain 9
  ENST ID: ENST00000579813
  CDS Start-End: 1-132
tacagagatgttgttgcagctccattctgcattttctattcctactgtcagatgggactgcaatttcctggccatttgagcaccagacaagatctacgcttatcaaaattgccaagccagcaaagtctatgattagaagtaggtaaatttttttaggactccctctccatttcttggagcactgtgcgtcttctccctttttcttgtaaaatctcctctttgctcttcagtaccataggtcaaaatgtgcttttaaaggtctttgtcatttcacatggtctaagcttaattaaagcagtgattttcaaacatt

SEQ ID NO: 128554 - DNA, 3147 bp, Homo sapiens
  Payload ID: 5162
  Gene Symbol: DNAH9
  Gene Name: dynein, axonemal, heavy chain 9
  Uniprot ID: Q9NYC9
  ENST ID: ENST00000608377
  CDS Start-End: 530-2926
tggttttaagaaacaagaaaggtcagggtggctgtggttggaacctccaacaggaaggttgttcttcccacgaatccaaaggctgtacaagggcaaagacactacagctgcctgaagttagtgctttaggatatggagcataaagagaggaagagatgagatccacttggataccagcaccccactccagcctcgaggaagcttttacacagtctgccatggttttacacagtttaaaactggaagacagattctgctgatttttttttaatccgatctcacaaagcagcagaatggattcaaaattaccctgaaaacgttggaagacagtcttctctctcgcctctcctccgcctctgggaacttcctgggagaaacagtgctggtggaaaacctagagatcaccaagcagactgctgccgaagttgagaaaaaggtccaggaggccaaggtgactgaagtgaaaatcaacgaggcccgagagcactaccggccagcagctgccagggcctcactgctctacttcatcatgaacgacctcagcaagatccatccaatgtaccagttttctctcaaggccttcagtatcgtcttccagaaggctgtggagagggctgctcctgacgaaagcctcagggagcgggtggccaacctaatagacagcataaccttctctgtgtaccagtacaccatccgcgggctctttgagtgtgataagctgacctaccttgcccagctcacctttcagattctcctcatgaaccgagaagtcaatgcagtggagttggatttcctgcttcgatctccagtgcagacgggcaccgccagccccgtggagttcctctcccatcaggcgtggggagctgtcaaggtactttcatcaatggaagaattctctaatctggatcgggacatagagggatctgctaagagctggaaaaagtttgtggagtccgaatgtcctgagaaagagaagctcccacaggagtggaagaacaagacagccctgcagcgcctctgcatgctgagagccatgcggcccgaccggatgacctatgctttgcgagattttgttgaagagaagttaggaagcaaatacgtggtgggaagagccctagattttgcaacctcatttgaagaatcgggaccagccactcctatgtttttcatcctgtctccaggggtggacccactgaaggatgtagaaagtcaaggaagaaaacttggatacaccttcaacaatcagaactttcacaacgtgtctttggggcaaggacaggaagtggtggctgaggctgcgctggacctcgctgccaagaaaggtcactgggttattttgcagaacattcacctggtggccaagtggctcagcaccctggagaagaagctggaggagcacagtgagaacagccacccagagttcagggtcttcatgagtgcagagccagcaccctcccctgagggccacatcatcccccagggcatcctggagaactccattaagatcaccaatgagccccccacgggcatgcatgccaacctgcacaaggccctggacaacttcactcaggacactctggagatgtgttctcgggagacggagtttaagagcatcctctttgctctttgttacttccatgcggtggtggcagaaagacgaaaatttgggccccagggatggaatcgctcatacccctttaacactggagacctcactatctctgtgaatgtcctctacaacttcctggaggccaacgcaaaggtcccctatgatgatttgcgctacctgtttggagagatcatgtatggaggccatatcacagatgactgggacagaagactctgcagaacctacctgggggaattcattcgaccagaaatgttagaaggagaactgtctttggccccagggttcccactcccaggcaacatggactacaatggttatcatcagtacatcgatgctgagctgcccccagaatccccctacctctatggcctccacccgaacgcagagattggcttcctgacccaaacctcagaaaagctcttccgcactgtgctggagctgcagcctcgggacagccaggccagagacggagcgggcgccacaagagaagaaaaggtcaaggcacttctggaagaaatattggagcgggtgacagacgagtttaacatcccagaactgatggccaaagtggaggagcgcaccccttacattgtagttgccttccaggagtgtggccggatgaatatcctcaccagagagattcagcgctcactgagggagctggagctcggcttaaagggggagctgactatgaccagccacatggagaacttacagaatgccctgtacttcgatatggtgccagagtcctgggctagacgagcctacccttccacagcaggcctggcagcctggtttccagacctcctcaacagaatcaaggagctagaggcttggacgggtgactttacaatgccctccactgtgtggctgacaggcttcttcaacccccagtcgttcctgactgccatcatgcagtccacggctcgcaagaatgagtggccactggaccagatggccctgcaatgtgacatgacgaagaagaacagagaagagtttaggagtcctcctcgggaaggggcctacatccatggcctcttcatggaaggtgcctgctgggacacacaggctgggatcattacagaggcaaagctgaaggatctgacaccccctatgcctgtgatgttcatcaaggccattcctgcagataagcaggactgccgcagtgtctattcctgtcctgtgtacaagactagtcagcggggacccacctacgtgtggactttcaacctgaagactaaggaaaacccatccaagtgggttctggctggagtagccttgcttctccagatttagcatcctgcagagccaccgagaaaataaaaaagctgggcttggaggctgcctagagggacaggtgggtgaagggtcaccacagacacttagaacggtaagaaaccatgagcactcacaattctgtagaattcctctagggaacttggagaggtgtgcctaaggtgaggctgagctgaaggaatgtgggcccaggtttcttaataaaatgatttactcttcaa

SEQ ID NO: 128555 - DNA, 2504 bp, Homo sapiens
  Payload ID: 5163
  Gene Symbol: DNAI1
  Gene Name: dynein, axonemal, intermediate chain 1
  Uniprot ID: Q9UI46
  ENST ID: ENST00000242317
  CDS Start-End: 172-2271
attctatcctgcaagggcacggggacccacaacgacggctgtccctaaagaaccgttgcgactggtaactgaagtggaagagagtccagatttcttgtgtgtggtcaaggagacggacaaactttttgtcttcagacgagggagcgttttgtaggctctccaggggttgagatgattcctgcttctgcgaaggctccccataaacagcctcataagcagagcatcagcataggcagaggaaccaggaagagagatgaagattcagggactgaagtgggagaaggcacagatgaatgggcccaatccaaagccacagttagaccccctgaccagctggagttgaccgatgcggagttaaaggaggagttcactcggattttgacagccaacaacccacacgcaccccagaacattgtcaggtacagcttcaaagaaggcacatataagcctattggctttgtgaaccaactggcagttcactacacccaggttgggaacctgatccccaaagactcagatgaaggacggcggcagcattaccgcgatgaattagtggcaggttctcaggagtctgtcaaggtgatttcagaaacaggaaacctcgaagaagacgaagagcccaaggagttagaaactgagcctgggagtcaaacagatgtgcctgcagctggggcagctgaaaaagtgactgaagaagaattgatgactcctaagcagcccaaggagagaaagctcactaaccagttcaacttcagtgagagggcctcacagacctacaacaaccctgtccgggatcgagaatgccagacggagcctcctcccaggacaaacttttcagccacagccaatcagtgggagatctatgatgcctatgtagaggaacttgagaagcaggaaaagaccaaagagaaggagaaggcaaagaccccagtggctaaaaaatcagggaagatggccatgaggaagctgacatctatggagtctcagactgatgatctcatcaaattgtcccaagctgctaagatcatggagcggatggtcaaccagaatacatatgatgacattgctcaagattttaagtactatgacgatgctgctgatgaataccgggaccaggtgggtaccctgctgccgctctggaagttccaaaatgacaaagccaagcgcctgtccgtcactgccctctgctggaatccaaagtacagggatctgtttgcagtgggatatggctcttatgacttcatgaagcagagccggggcatgctgctgctctacagcctgaagaaccccagcttccctgagtacatgttcagcagcaacagcggcgtcatgtgtctcgacatccacgtggaccacccctacctggtggcagtaggccactatgacggcaacgtggccatttacaacctcaagaagccccactcccagccctccttctgcagctcagccaagtctggcaagcactcagaccctgtgtggcaggtcaagtggcagaaggatgacatggaccaaaaccttaacttcttctctgtgtcatctgacggcaggattgtgtcttggactctcgtgaagagaaagctggttcacatagatgtcatcaagctgaaggtggaaggcagcaccacggaagttcctgaggggttgcagctgcacccagtgggttgtggcactgcctttgacttccacaaagagattgactacatgttcctagtgggcacagaggagggaaaaatctacaagtgctctaaatcctactccagccaattcctcgacacctatgacgcccacaacatgtcagtggacactgtgtcctggaacccataccacaccaaggtcttcatgtcctgcagctccgactggacagtgaagatctgggaccacaccatcaagaccccgatgttcatctatgacctgaactcagccgtgggtgatgtggcctgggcgccatactcttctactgtgttcgcagcagtcaccacagatgggaaggcccacatatttgacttagccatcaacaagtatgaggccatctgcaaccagcctgtggcggccaaaaagaacaggctcacccacgtgcagttcaatctcatccaccccatcatcattgtgggcgatgaccgtgggcacatcatcagcctcaagctctcacccaatttgcgcaagatgccaaaggaaaagaaggggcaggaggtgcagaagggtccagctgtggagattgcgaaactggacaaactgctgaacctggtgagggaagtgaaaatcaagacctgaggggctggcctcagtctctgtcccatcgcttgaatacagtactcctagggcttgaccctggtacccagcccagccttagcacccagcatgtgaccccactcctgatcaggtcccagcatcttcccttcttgttctgttccttaaggtcccagcaccttaccccaggacttggtcttcaaccaccattacccctctaactttgcacaaataaacctgtgtagaaacccacccca

SEQ ID NO: 128556 - DNA, 1039 bp, Homo sapiens
  Payload ID: 5163
  Gene Symbol: DNAI1
  Gene Name: dynein, axonemal, intermediate chain 1
  ENST ID: ENST00000437363
  CDS Start-End: 172-1039
attctatcctgcaagggcacggggacccacaacgacggctgtccctaaagaaccgttgcgactggtaactgaagtggaagagagtccagatttcttgtgtgtggtcaaggagacggacaaactttttgtcttcagacgagggagcgttttgtaggctctccaggggttgagatgattcctgcttctgcgaaggctccccataaacagcctcataagcaggatgaagattcagggactgaagtgggagaaggcacagatgaatgggcccaatccaaagccacagttagaccccctgaccagctggagttgaccgatgcggagttaaaggaggagttcactcggattttgacagccaacaacccacacgcaccccagaacattgtcaggtacagcttcaaagaaggcacatataagcctattggctttgtgaaccaactggcagttcactacacccaggttgggaacctgatccccaaagactcagatgaaggacggcggcagcattaccgcgatgaattagtggcaggttctcaggagtctgtcaaggtgatttcagaaacaggaaacctcgaagaagacgaagagcccaaggagttagaaactgagcctgggagtcaaacagatgtgcctgcagctggggcagctgaaaaagtgactgaagaagaattgatgactcctaagcagcccaaggagagaaagctcactaaccagttcaacttcagtgagagggcctcacagacctacaacaaccctgtccgggatcgagaatgccagacggagcctcctcccaggacaaacttttcagccacagccaatcagtgggagatctatgatgcctatgtagaggaacttgagaagcaggaaaagaccaaagagaaggagaaggcaaagaccccagtggctaaaaaatcagggaagatggccatgaggaagctgacatctatggagtctcagactgatgatctcatcaaattgtcccaagctgctaagatcatggagcggatggtcaaccagaatacatatgatgacattgctcaag

SEQ ID NO: 128557 - DNA, 656 bp, Homo sapiens
  Payload ID: 5163
  Gene Symbol: DNAI1
  Gene Name: dynein, axonemal, intermediate chain 1
  ENST ID: ENST00000442556
  CDS Start-End: 1-428
gttgtggcactgcctttgacttccacaaagagattgactacatgttcctagtgggcacagaggagggaaaaatctacaagtgctctaaatcctactccagccaattcctcgacacctatgacgcccacaacatgtcagtggacactgtgtcctggaacccataccacaccaaggtcttcatgtcctgcagctccgactggacagtgaagatctgggaccacaccatcaagaccccgatgttcatctatgacctgaactcagccgtgggtgatgtggcctgggcgccatactcttctactgtgttcgcagcagtcaccacagatgggaaggaaaagaaggggcaggaggtgcagaagggtccagctgtggagattgcgaaactggacaaactgctgaacctggtgagggaagtgaaaatcaagacctgaggggctggcctcagtctctgtcccatcgcttgaatacagtactcctagggcttgaccctggtacccagcccagccttagcacccagcatgtgaccccactcctgatcaggtcccagcatcttcccttcttgttctgttccttaaggtcccagcaccttaccccaggacttggtcttcaaccaccattacccctctaactttgcacaaataaacctgtgtagaaaccca

SEQ ID NO: 128558 - DNA, 789 bp, Homo sapiens
  Payload ID: 5163
  Gene Symbol: DNAI1
  Gene Name: dynein, axonemal, intermediate chain 1
  ENST ID: ENST00000470169
  CDS Start-End: 1-527
atgacttcatgaagcagagccggggcatgctgctgctctacagcctgaagaaccccagcttccctgagtacatgttcagcagcaacagcggcgtcatgtgtctcgacatccacgtggaccacccctacctggtggcagtaggccactatgacggcaacgtggccatttacaacctcaagaagccccactcccagccctccttctgcagctcagccaagtctggcaagcactcagaccctgtgtggcaggtcaagtggcagaaggatgacatggaccaaaaccttaacttcttctctgtgtcatctgacggcaggattgtgtcttggactctcgtgaagagaaagctggttcacatagatgtcatcaagctgaaggtggaaggcagcaccacggaagttcctgaggggttgcagctgcacccagtgggttgtggcactgcctttgacttccacaaagagattgactacatgttcctagtgggcacagaggagggaaaaatctacaaggaccccgatgttcatctatgacctgaactcagccgtgggtgatgtggcctgggcgccatactcttctactgtgttcgcagcagtcaccacagatgggaaggcccacatatttgacttagccatcaacaagtatgaggccatctgcaaccagcctgtggcggccaaaaagaacaggctcacccacgtgcagttcaatctcatccaccccatcatcattgtgggcgatgaccgtgggcacatcatcagcctcaagctctcacccaatttgcgcaagatgccaaag

SEQ ID NO: 128559 - DNA, 2598 bp, Homo sapiens
  Payload ID: 5163
  Gene Symbol: DNAI1
  Gene Name: dynein, axonemal, intermediate chain 1
  ENST ID: ENST00000614641
  CDS Start-End: 255-2366
tcctttccgggccggctgggcgcgccgaagcgcctgcgccttggctgctggtcggttgctgggtaaccgcgtcagggagttggattctatcctgcaagggcacggggacccacaacgacggctgtccctaaagaaccgttgcgactggtaactgaagtggaagagagtccagatttcttgtgtgtggtcaaggagacggacaaactttttgtcttcagacgagggagcgttttgtaggctctccaggggttgagatgattcctgcttctgcgaaggctccccataaacagcctcataagcagagcatcagcataggcagaggaaccaggaagagagatgaagattcagggactgaagtgggagaaggcacagatgaatgggcccaatccaaagccacagttagaccccctgaccagctggagttgaccgatgcggagttaaaggaggagttcactcggattttgacagccaacaacccacacgcaccccagaacattgtcaggtacagcttcaaagaaggcacatataagcctattggctttgtgaaccaactggcagttcactacacccaggttgggaacctgatccccaaagactcagatgaaggacggcggcagcattaccgcgatgaattagtggcagtatcctaccaaggttctcaggagtctgtcaaggtgatttcagaaacaggaaacctcgaagaagacgaagagcccaaggagttagaaactgagcctgggagtcaaacagatgtgcctgcagctggggcagctgaaaaagtgactgaagaagaattgatgactcctaagcagcccaaggagagaaagctcactaaccagttcaacttcagtgagagggcctcacagacctacaacaaccctgtccgggatcgagaatgccagacggagcctcctcccaggacaaacttttcagccacagccaatcagtgggagatctatgatgcctatgtagaggaacttgagaagcaggaaaagaccaaagagaaggagaaggcaaagaccccagtggctaaaaaatcagggaagatggccatgaggaagctgacatctatggagtctcagactgatgatctcatcaaattgtcccaagctgctaagatcatggagcggatggtcaaccagaatacatatgatgacattgctcaagattttaagtactatgacgatgctgctgatgaataccgggaccaggtgggtaccctgctgccgctctggaagttccaaaatgacaaagccaagcgcctgtccgtcactgccctctgctggaatccaaagtacagggatctgtttgcagtgggatatggctcttatgacttcatgaagcagagccggggcatgctgctgctctacagcctgaagaaccccagcttccctgagtacatgttcagcagcaacagcggcgtcatgtgtctcgacatccacgtggaccacccctacctggtggcagtaggccactatgacggcaacgtggccatttacaacctcaagaagccccactcccagccctccttctgcagctcagccaagtctggcaagcactcagaccctgtgtggcaggtcaagtggcagaaggatgacatggaccaaaaccttaacttcttctctgtgtcatctgacggcaggattgtgtcttggactctcgtgaagagaaagctggttcacatagatgtcatcaagctgaaggtggaaggcagcaccacggaagttcctgaggggttgcagctgcacccagtgggttgtggcactgcctttgacttccacaaagagattgactacatgttcctagtgggcacagaggagggaaaaatctacaagtgctctaaatcctactccagccaattcctcgacacctatgacgcccacaacatgtcagtggacactgtgtcctggaacccataccacaccaaggtcttcatgtcctgcagctccgactggacagtgaagatctgggaccacaccatcaagaccccgatgttcatctatgacctgaactcagccgtgggtgatgtggcctgggcgccatactcttctactgtgttcgcagcagtcaccacagatgggaaggcccacatatttgacttagccatcaacaagtatgaggccatctgcaaccagcctgtggcggccaaaaagaacaggctcacccacgtgcagttcaatctcatccaccccatcatcattgtgggcgatgaccgtgggcacatcatcagcctcaagctctcacccaatttgcgcaagatgccaaaggaaaagaaggggcaggaggtgcagaagggtccagctgtggagattgcgaaactggacaaactgctgaacctggtgagggaagtgaaaatcaagacctgaggggctggcctcagtctctgtcccatcgcttgaatacagtactcctagggcttgaccctggtacccagcccagccttagcacccagcatgtgaccccactcctgatcaggtcccagcatcttcccttcttgttctgttccttaaggtcccagcaccttaccccaggacttggtcttcaaccaccattacccctctaactttgcacaaataaacctgtgtagaaacccacccc

SEQ ID NO: 128560 - DNA, 2236 bp, Homo sapiens
  Payload ID: 5164
  Gene Symbol: DNAI2
  Gene Name: dynein, axonemal, intermediate chain 2
  Uniprot ID: Q9GZS0
  ENST ID: ENST00000311014
  CDS Start-End: 68-1885
cgaccgtggattgaacgcttccccagagacccagaagcagaaggagcggacccaggcagccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggccaactcagagcggtttgagatggagacccggggagttaaccatgtcgaggggggctggcccaaggacgtgaaccccctggagctggagcagaccatccgtttccggaagaaagtggagaaagatgagaactacgttaacgccatcatgcagctcggctctatcatggagcactgcatcaagcagaacaatgccattgacatctatgaagagtatttcaatgacgaggaggccatggaagtgatggaggaggacccttcagctaaaaccatcaatgtgttcagggacccccaggaaatcaagagggctgccacacacctctcctggcaccccgatggcaacaggaagttggcagtggcatactcctgcttggattttcagcgggcacctgtgggcatgagcagcgattcatacatctgggacctggaaaaccccaacaagcctgaacttgctctgaagccatcgtctccactcgtgacgttggagttcaaccccaaagattcccacgtactcctgggtggctgctacaatggacagatagcctgctgggacacccgaaagggcagcctggtggcggagctatccaccattgagtccagccaccgagaccctgtgtatggcaccatctggctgcagtcgaagacgggcaccgagtgcttctcagcttccacggatgggcaggtcatgtggtgggacatccgaaagatgagcgagcccactgaagttgtgatcttggacatcaccaagaaggaacagttggaaaatgccttgggggccatctccctggagttcgaatctactttgcccaccaagttcatggtggggaccgagcagggcatcgtcatctcctgcaaccgcaaggccaagacgtcagctgaaaagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaccacatggcttacctcactgatgctgcctggagccccgtgaggccgaccgttttctttaccaccaggatggacggaaccctggatatctgggacttcatgttcgagcagtgcgatcccaccctcagcttgaaggtgtgtgacgaggccctcttctgcctccgggtgcaggacaatgggtgtctcatcgcctgcggctcccagctggggacaaccaccctgctggaggtctcgcctgggctctctaccctccagaggaatgagaagaacgtagcctcttccatgtttgagcgtgagacccggcgagagaagatcctggaggccaggcaccgggagatgcggctgaaggagaagggtaaggcggagggcagggatgaggagcagaccgatgaggagctggccgtagacctggaggcgctggtcagcaaggccgaggaggagttcttcgacatcatcttcgcagagctgaagaagaaggaggcagacgccataaagctgacgccagtgcctcagcaaccaagtccagaagaagaccaggtggtggaggagggagaggaagcagcgggggaagaaggggatgaagaagtggaagaagacttagcctagaagtcagccttcgactgcggcgctatccctgtgtgccttcctttcccacctcttgaccctcaaccagacttgcatggccatggcagggcctcgggaagaccttcaggagtggggaagggtttctcctccatgatcgaccctcctcgtccacctacaaatcaggaacagaaagtctgtccactttgaaaatacctttccaggcagctccctgaccatttggacacattgccacgacaggagcctccaagtatgtgggaggggacgggcgggacgagcttggctgttctgctgcacctgaatgctttctgttatcctaattcttgtaaaattaaatgaatcgtaacaatgcca

SEQ ID NO: 128561 - DNA, 2474 bp, Homo sapiens
  Payload ID: 5164
  Gene Symbol: DNAI2
  Gene Name: dynein, axonemal, intermediate chain 2
  Uniprot ID: Q9GZS0
  ENST ID: ENST00000446837
  CDS Start-End: 307-2124
cctcccaatgtgctgggattacagttgtcagctaccgcgcctggccaaaatttttattgccctcctcagagagcaactgcaataactaaacagggtaatgcttagcatatagtcggcactcaggatttttttttaatgcggatgcagcttctggacaaattcctaggatctccccaccaccccttgcttcctgccccaaccagattgagaacctggagctgtcctggcaggacctgtggagatagggaaggggccggtggggtccctcaccccacaccctccctctgccccccagcagccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggccaactcagagcggtttgagatggagacccggggagttaaccatgtcgaggggggctggcccaaggacgtgaaccccctggagctggagcagaccatccgtttccggaagaaagtggagaaagatgagaactacgttaacgccatcatgcagctcggctctatcatggagcactgcatcaagcagaacaatgccattgacatctatgaagagtatttcaatgacgaggaggccatggaagtgatggaggaggacccttcagctaaaaccatcaatgtgttcagggacccccaggaaatcaagagggctgccacacacctctcctggcaccccgatggcaacaggaagttggcagtggcatactcctgcttggattttcagcgggcacctgtgggcatgagcagcgattcatacatctgggacctggaaaaccccaacaagcctgaacttgctctgaagccatcgtctccactcgtgacgttggagttcaaccccaaagattcccacgtactcctgggtggctgctacaatggacagatagcctgctgggacacccgaaagggcagcctggtggcggagctatccaccattgagtccagccaccgagaccctgtgtatggcaccatctggctgcagtcgaagacgggcaccgagtgcttctcagcttccacggatgggcaggtcatgtggtgggacatccgaaagatgagcgagcccactgaagttgtgatcttggacatcaccaagaaggaacagttggaaaatgccttgggggccatctccctggagttcgaatctactttgcccaccaagttcatggtggggaccgagcagggcatcgtcatctcctgcaaccgcaaggccaagacgtcagctgaaaagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaccacatggcttacctcactgatgctgcctggagccccgtgaggccgaccgttttctttaccaccaggatggacggaaccctggatatctgggacttcatgttcgagcagtgcgatcccaccctcagcttgaaggtgtgtgacgaggccctcttctgcctccgggtgcaggacaatgggtgtctcatcgcctgcggctcccagctggggacaaccaccctgctggaggtctcgcctgggctctctaccctccagaggaatgagaagaacgtagcctcttccatgtttgagcgtgagacccggcgagagaagatcctggaggccaggcaccgggagatgcggctgaaggagaagggtaaggcggagggcagggatgaggagcagaccgatgaggagctggccgtagacctggaggcgctggtcagcaaggccgaggaggagttcttcgacatcatcttcgcagagctgaagaagaaggaggcagacgccataaagctgacgccagtgcctcagcaaccaagtccagaagaagaccaggtggtggaggagggagaggaagcagcgggggaagaaggggatgaagaagtggaagaagacttagcctagaagtcagccttcgactgcggcgctatccctgtgtgccttcctttcccacctcttgaccctcaaccagacttgcatggccatggcagggcctcgggaagaccttcaggagtggggaagggtttctcctccatgatcgaccctcctcgtccacctacaaatcaggaacagaaagtctgtccactttgaaaatacctttccaggcagctccctgaccatttggacacattgccacgacaggagcctccaagtatgtgggaggggacgggcgggacgagcttggctgttctgctgcacctgaatgctttctgttatcctaattcttgtaaaattaaatgaatcgtaacaatgcc

SEQ ID NO: 128562 - DNA, 2240 bp, Homo sapiens
  Payload ID: 5164
  Gene Symbol: DNAI2
  Gene Name: dynein, axonemal, intermediate chain 2
  Uniprot ID: Q9GZS0
  ENST ID: ENST00000582036
  CDS Start-End: 108-1889
caagcaaccggtaaacgccgccgtttgaggagcaccggagccgcgaccgtggattgaacgcttccccagagacccagaagcagaaggagcggacccaggccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggccaactcagagcggtttgagatggagacccggggagttaaccatgtcgaggggggctggcccaaggacgtgaaccccctggagctggagcagaccatccgtttccggaagaaagtggagaaagatgagaactacgttaacgccatcatgcagctcggctctatcatggagcactgcatcaagcagaacaatgccattgacatctatgaagagtatttcaatgacgaggaggccatggaagtgatggaggaggacccttcagctaaaaccatcaatgtgttcagggacccccaggaaatcaagagggctgccacacacctctcctggcaccccgatggcaacaggaagttggcagtggcatactcctgcttggattttcagcgggcacctgtgggcatgagcagcgattcatacatctgggacctggaaaaccccaacaagcctgaacttgctctgaagccatcgtctccactcgtgacgttggagttcaaccccaaagattcccacgtactcctgggtggctgctacaatggacagatagcctgctgggacacccgaaagggcagcctggtggcggagctatccaccattgagtccagccaccgagaccctgtgtatggcaccatctggctgcagtcgaagacgggcaccgagtgcttctcagcttccacggatgggcaggtcatgtggtgggacatccgaaagatgagcgagcccactgaagttgtgatcttggacatcaccaagaaggaacagttggaaaatgccttgggggccatctccctggagttcgaatctactttgcccaccaagttcatggtggggaccgagcagggcatcgtcatctcctgcaaccgcaaggccaagacgtcagctgaaaagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaccacatggcttacctcactgatgctgcctggagccccgtgaggccgaccgttttctttaccaccaggatggacggaaccctggatatctgggacttcatgttcgagcagtgcgatcccaccctcagcttgaaggacaatgggtgtctcatcgcctgcggctcccagctggggacaaccaccctgctggaggtctcgcctgggctctctaccctccagaggaatgagaagaacgtagcctcttccatgtttgagcgtgagacccggcgagagaagatcctggaggccaggcaccgggagatgcggctgaaggagaagggtaaggcggagggcagggatgaggagcagaccgatgaggagctggccgtagacctggaggcgctggtcagcaaggccgaggaggagttcttcgacatcatcttcgcagagctgaagaagaaggaggcagacgccataaagctgacgccagtgcctcagcaaccaagtccagaagaagaccaggtggtggaggagggagaggaagcagcgggggaagaaggggatgaagaagtggaagaagacttagcctagaagtcagccttcgactgcggcgctatccctgtgtgccttcctttcccacctcttgaccctcaaccagacttgcatggccatggcagggcctcgggaagaccttcaggagtggggaagggtttctcctccatgatcgaccctcctcgtccacctacaaatcaggaacagaaagtctgtccactttgaaaatacctttccaggcagctccctgaccatttggacacattgccacgacaggagcctccaagtatgtgggaggggacgggcgggacgagcttggctgttctgctgcacctgaatgctttctgttatcctaattcttgtaaaattaaatgaatcgtaacaatgcca

SEQ ID NO: 128563 - DNA, 1993 bp, Homo sapiens
  Payload ID: 5164
  Gene Symbol: DNAI2
  Gene Name: dynein, axonemal, intermediate chain 2
  ENST ID: ENST00000579055
  CDS Start-End: 102-608
ggtaaacgccgccgtttgaggagcaccggagccgcgaccgtggattgaacgcttccccagagacccagaagcagaaggagcggacccaggcagccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggccaactcagagcggtttgagatggagacccggggagttaaccatgtcgaggggggctggcccaaggacgtgaaccccctggagctggagcagaccatccgtttccggaagaaagtggagaaagatgagaactacgttaacgccatcatgcagctcggctctggacccccaggaaatcaagagggctgccacacacctctcctggcaccccgatggcaacaggaagttggcagtggcatactcctgcttggattttcagcgggcacctgtgggcatgagcagcgattcatacatctgggacctggaaaaccccaacaagcctgaacttgctctgaagccatcgtctccactcgtgacgttggagttcaaccccaaagattcccacgtactcctgggtggctgctacaatggacagatagcctgctgggacacccgaaagggcagcctggtggcggagctatccaccattgagtccagccaccgagaccctgtgtatggcaccatctggctgcagtcgaagacgggcaccgagtgcttctcagcttccacggatgggcaggtcatgtggtgggacatccgaaagatgagcgagcccactgaagttgtgatcttggacatcaccaagaaggaacagttggaaaatgccttgggggccatctccctggagttcgaatctactttgcccaccaagttcatggtggggaccgagcagggcatcgtcatctcctgcaaccgcaaggccaagacgtcagctgaaaagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaccacatggcttacctcactgatgctgcctggagccccgtgaggccgaccgttttctttaccaccaggatggacggaaccctggatatctgggacttcatgttcgagcagtgcgatcccaccctcagcttgaaggtgtgtgacgaggccctcttctgcctccgggtgcaggacaatgggtgtctcatcgcctgcggctcccagctggggacaaccaccctgctggaggtctcgcctgggctctctaccctccagaggaatgagaagaacgtagcctcttccatgtttgagcgtgagacccggcgagagaagatcctggaggccaggcaccgggagatgcggctgaaggagaaggcagcaaccaagtccagaagaagaccaggtggtggaggagggagaggaagcagcgggggaagaaggggatgaagaagtggaagaagacttagcctagaagtcagccttcgactgcggcgctatccctgtgtgccttcctttcccacctcttgaccctcaaccagacttgcatggccatggcagggcctcgggaagaccttcaggagtggggaagggtttctcctccatgatcgaccctcctcgtccacctacaaatcaggaacagaaagtctgtccactttgaaaatacctttccaggcagctccctgaccatttggacacattgccacgacaggagcctccaagtatgtgggaggggacgggcgggacgagcttggctgttctgctgcacctgaatgctttctgttatcctaattcttgtaaaattaaatgaatcgtaacaatgcca

SEQ ID NO: 128564 - DNA, 2475 bp, Homo sapiens
  Payload ID: 5164
  Gene Symbol: DNAI2
  Gene Name: dynein, axonemal, intermediate chain 2
  ENST ID: ENST00000579490
  CDS Start-End: 136-2124
cctcccaatgtgctgggattacagttgtcagctaccgcgcctggccaaaatttttattgccctcctcagagagcaactgcaataactaaacagggtaatgcttagcatatagtcggcactcaggatttttttttaatgcggatgcagcttctggacaaattcctaggatctccccaccaccccttgcttcctgccccaaccagattgagaacctggagctgtcctggcaggacctgtggagatagggaaggggccggtggggtccctcaccccacaccctccctctgccccccagcagccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggccaactcagagcggtttgagatggagacccggggagttaaccatgtcgaggggggctggcccaaggacgtgaaccccctggagctggagcagaccatccgtttccggaagaaagtggagaaagatgagaactacgttaacgccatcatgcagctcggctctatcatggagcactgcatcaagcagaacaatgccattgacatctatgaagagtatttcaatgacgaggaggccatggaagtgatggaggaggacccttcagctaaaaccatcaatgtgttcagggacccccaggaaatcaagagggctgccacacacctctcctggcaccccgatggcaacaggaagttggcagtggcatactcctgcttggattttcagcgggcacctgtgggcatgagcagcgattcatacatctgggacctggaaaaccccaacaagcctgaacttgctctgaagccatcgtctccactcgtgacgttggagttcaaccccaaagattcccacgtactcctgggtggctgctacaatggacagatagcctgctgggacacccgaaagggcagcctggtggcggagctatccaccattgagtccagccaccgagaccctgtgtatggcaccatctggctgcagtcgaagacgggcaccgagtgcttctcagcttccacggatgggcaggtcatgtggtgggacatccgaaagatgagcgagcccactgaagttgtgatcttggacatcaccaagaaggaacagttggaaaatgccttgggggccatctccctggagttcgaatctactttgcccaccaagttcatggtggggaccgagcagggcatcgtcatctcctgcaaccgcaaggccaagacgtcagctgaaaagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaccacatggcttacctcactgatgctgcctggagccccgtgaggccgaccgttttctttaccaccaggatggacggaaccctggatatctgggacttcatgttcgagcagtgcgatcccaccctcagcttgaaggtgtgtgacgaggccctcttctgcctccgggtgcaggacaatgggtgtctcatcgcctgcggctcccagctggggacaaccaccctgctggaggtctcgcctgggctctctaccctccagaggaatgagaagaacgtagcctcttccatgtttgagcgtgagacccggcgagagaagatcctggaggccaggcaccgggagatgcggctgaaggagaagggtaaggcggagggcagggatgaggagcagaccgatgaggagctggccgtagacctggaggcgctggtcagcaaggccgaggaggagttcttcgacatcatcttcgcagagctgaagaagaaggaggcagacgccataaagctgacgccagtgcctcagcaaccaagtccagaagaagaccaggtggtggaggagggagaggaagcagcgggggaagaaggggatgaagaagtggaagaagacttagcctagaagtcagccttcgactgcggcgctatccctgtgtgccttcctttcccacctcttgaccctcaaccagacttgcatggccatggcagggcctcgggaagaccttcaggagtggggaagggtttctcctccatgatcgaccctcctcgtccacctacaaatcaggaacagaaagtctgtccactttgaaaatacctttccaggcagctccctgaccatttggacacattgccacgacaggagcctccaagtatgtgggaggggacgggcgggacgagcttggctgttctgctgcacctgaatgctttctgttatcctaattcttgtaaaattaaatgaatcgtaacaatgcca

SEQ ID NO: 128565 - DNA, 2312 bp, Homo sapiens
  Payload ID: 5165
  Gene Symbol: DNAL1
  Gene Name: dynein, axonemal, light chain 1
  Uniprot ID: Q4LDG9
  ENST ID: ENST00000311089
  CDS Start-End: 261-494
aaccagagcagtgacagtagcaaccgccggaatggcgaaagcaacaacaatcaaagaagccttagcgagatgggaagctttcactgtctacaaactgcattgaaaaaattgccaacctgaatggcttaaaaaacttgaggatattatctttaggaagaaacaacataaagaacttaaatggactggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtgcccaaactgaaaaagctggatggtactccagtaattaaaggggatgaggaagaagacaactaatgccacgctttccactgtgtgttaacttatttaaatgtcataagaacaatagataaattttatataattgtctattttaaagattctgtatgggacaaaagtttcttaagataaaacagatcactcattctcatctttttttttcctttaacttattcagtgtttctccccaaaactggtaatgccaaccttatatatcctatttctctttttagaaaccacaaattttcgatttttgtcttcagtctcagttacgtactgtgtagccccatctactaaaacaaaacctttgtagaccagtcatttttaataacaaaggaacaaatgtttttttcagtttgttcattttttttaggttagacattttaaaagatgtacatttgaaaattcagaacatttttcctgaaggtctgtctctgtacaattcagaagcacatgcctttagctcagaaggcagcatggtgatgggaagagttcctcttagaaatacagcaggtccggaaccaagactccaaagttccattggaaaagatatggtgaaaaaaggaaaaagtagtatctcagagaccttctagtctatattatacttatttgtttttccaaaaatgtgcacattgtcaactggaatttaggttgtttttatatgcatggccacttgagtcattgtgtacagtcattctgtgatctcagttagtggttaaaatgactgtcatgatcatttctttgactgataatgtggcaatgttactcatgtggacctcgccttaagcacacattttggttttatagttccttatgtgtttaaagcattagttatatttgaattcctagactaaatgctggccattgatgtatgtcaaaatttaccctaattatttggtctggtgaccctcattgttgggaaaagtgactaccatggttataagtaagggtataatgaaacttagtatttcaaaatatattttttgagaagttctaagttaaacagctcttaaaatgtattatgtacgtggttgtggagggaagggagatgtttcattatgagatcccaggcaaatggcaatatgtttgaggattgtctcctacataaagcagtgtaggtgatttaacctcaaaattgcaaagcaatagttagatgcagaggttagaatttatcatgtaaacaaaaaatccttcaggaaaatgtaagacattgtagtcagtaagcagatgaggtcataggaggccatggctggatcactattagattgcagaaaagaagtcaggggccctctgccaaattgtgcctaaagtccctcagagactgttgattctggtttccccatctacttgtgtgattttacttgcataaaatcacagtgaaagagggaagaatcatctttaaaaagtgattgcataagtagtcctgggtttcagaagatttcagctatcatttacataggaattacttgatttttctaagttactctgatcaaaagggaccactgctttgacaatcaactctaaatacaaacaagaggccaggcgtggtggctcatgcctgtcatcccagcactttgggaggccgaggcgggcggatcatctgagatcaggagttcaagaccagcctgaccaacatggtgaaaccccgtctctactaaaaatacaaaaattagccagtcctggtggtgggcgcctgtagtcccaactactcgggaggctgaggcaggagaatcatttgaacccgggaggcggaggttgcagtgagccgagattgcgccattgcactccagcctgggcaatagagcgagactccatatttaaaaaaaaaaaaaaaaa

SEQ ID NO: 128566 - DNA, 548 bp, Homo sapiens
  Payload ID: 5165
  Gene Symbol: DNAL1
  Gene Name: dynein, axonemal, light chain 1
  ENST ID: ENST00000554339
  CDS Start-End: 23-334
agtgacagtagcaaccgccggaatggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtgcccaaactgaaaaagctggatggtactccagtaattaaaggggatgaggaagaagacaactaatgccacgctttccactgtgtgttaacttatttaaatgtcataagaacaatagataaattttatataattgtctattttaaagattctgtatgggacaaaagtttcttaagataaaacagatcactcattctcatctttttttttcctttaacttattcagtgtttctccccaaaactggtaatgccaaccttatatatcctatttctcttttta

SEQ ID NO: 128567 - DNA, 504 bp, Homo sapiens
  Payload ID: 5165
  Gene Symbol: DNAL1
  Gene Name: dynein, axonemal, light chain 1
  ENST ID: ENST00000555919
  CDS Start-End: 348-504
cagtgacagtagcaaccgccggaatgagatggggtcttgctgtgttgtccaggctggtctcaaactcctggcctcaagtgatcctccagccttggcttcccatagtgctgggattgcaggcatgagccaccatgtccagcttgaagatataatattgtatctaggattttcaaatccatgttgaaaactgggccttgattggttgagtcaagtgagctgattggttgattcaggcgaaagcaacaacaatcaaagaagccttagcgagatgggaagagaaaactggccagaggccatctgaagccaaagagataaaactttatgcccagattccccctatagagaagatggatgcatccttgtccatgcttgctaattgcgagaagctttcactgtctacaaactgcattgaaaaaattgccaacctgaatggcttaaaaaacttgaggatattatctttaggaagaaacaacataaagaacttaaatggactggaggcagtag

SEQ ID NO: 128568 - DNA, 452 bp, Homo sapiens
  Payload ID: 5165
  Gene Symbol: DNAL1
  Gene Name: dynein, axonemal, light chain 1
  ENST ID: ENST00000554159
  CDS Start-End: 1-204
cagaggccatctgaagccaaagagataaaactttatgcccagattccccctatagagaagatggatgcatccttgtccatgcttgctaattgcgagaagctttcactgtctacaaactgcattgaaaaaattgccaacctgaatggcttaagaggcagtaggggacacattagaagaactgtggatctcctacaattttattgagaagttgaaagggatccacataatgaagaaattgaagattctctacatgtctaataacctggtaaaagactggggtactccagtaattaaaggggatgaggaagaagacaactaatgccacgctttccactgtgtgttaacttatttaaatgtcataagaacaatagataaattttatataattgtctattttaaagattctgtatgggacaaaagtttcttaagataaaacagatcactcattctca

SEQ ID NO: 128569 - DNA, 627 bp, Homo sapiens
  Payload ID: 5165
  Gene Symbol: DNAL1
  Gene Name: dynein, axonemal, light chain 1
  ENST ID: ENST00000555631
  CDS Start-End: 213-627
gaccccgcgggccctagcaaccagagcagtgacagtagcaaccgccggaatgctgggccttgattggttgagtcaagtgagctgattggttgattcaggcgaaagcaacaacaatcaaagaagccttagcgagatgggaagagaaaactggccagaggccatctgaagccaaagagataaaactttatgcccagattccccctatagagaagatggatgcatccttgtccatgcttgctaattgcgagaagctttcactgtctacaaactgcattgaaaaaattgccaacctgaatggcttaaaaaacttgaggatattatctttaggaagaaacaacataaagaacttaaatggactggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtgcccaaactgaaaaagctggatg

SEQ ID NO: 128570 - DNA, 632 bp, Homo sapiens
  Payload ID: 5165
  Gene Symbol: DNAL1
  Gene Name: dynein, axonemal, light chain 1
  Uniprot ID: Q4LDG9
  ENST ID: ENST00000554871
  CDS Start-End: 177-632
agcaaccgccggaatgctgggccttgattggttgagtcaagtgagctgattggttgattcaggcgaaagcaacaacaatcaaagaagccttagcgagatgggaagagaaaactggccagaggccatctgaagccaaagagataaaactttatgcccagattccccctatagagaagatggatgcatccttgtccatgcttgctaattgcgagaagctttcactgtctacaaactgcattgaaaaaattgccaacctgaatggcttaaaaaacttgaggatattatctttaggaagaaacaacataaagaacttaaatggactggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtgcccaaactgaaaaagctggatggtactccagtaattaaaggggatgaggaagaagacaactaa

SEQ ID NO: 128571 - DNA, 8404 bp, Homo sapiens
  Payload ID: 5165
  Gene Symbol: DNAL1
  Gene Name: dynein, axonemal, light chain 1
  Uniprot ID: Q4LDG9
  ENST ID: ENST00000553645
  CDS Start-End: 42-614
gggccctagcaaccagagcagtgacagtagcaaccgccggaatggcgaaagcaacaacaatcaaagaagccttagcgagatgggaagagaaaactggccagaggccatctgaagccaaagagataaaactttatgcccagattccccctatagagaagatggatgcatccttgtccatgcttgctaattgcgagaagctttcactgtctacaaactgcattgaaaaaattgccaacctgaatggcttaaaaaacttgaggatattatctttaggaagaaacaacataaagaacttaaatggactggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtgcccaaactgaaaaagctggatggtactccagtaattaaaggggatgaggaagaagacaactaatgccacgctttccactgtgtgttaacttatttaaatgtcataagaacaatagataaattttatataattgtctattttaaagattctgtatgggacaaaagtttcttaagataaaacagatcactcattctcatctttttttttcctttaacttattcagtgtttctccccaaaactggtaatgccaaccttatatatcctatttctctttttagaaaccacaaattttcgatttttgtcttcagtctcagttacgtactgtgtagccccatctactaaaacaaaacctttgtagaccagtcatttttaataacaaaggaacaaatgtttttttcagtttgttcattttttttaggttagacattttaaaagatgtacatttgaaaattcagaacatttttcctgaaggtctgtctctgtacaattcagaagcacatgcctttagctcagaaggcagcatggtgatgggaagagttcctcttagaaatacagcaggtccggaaccaagactccaaagttccattggaaaagatatggtgaaaaaaggaaaaagtagtatctcagagaccttctagtctatattatacttatttgtttttccaaaaatgtgcacattgtcaactggaatttaggttgtttttatatgcatggccacttgagtcattgtgtacagtcattctgtgatctcagttagtggttaaaatgactgtcatgatcatttctttgactgataatgtggcaatgttactcatgtggacctcgccttaagcacacattttggttttatagttccttatgtgtttaaagcattagttatatttgaattcctagactaaatgctggccattgatgtatgtcaaaatttaccctaattatttggtctggtgaccctcattgttgggaaaagtgactaccatggttataagtaagggtataatgaaacttagtatttcaaaatatattttttgagaagttctaagttaaacagctcttaaaatgtattatgtacgtggttgtggagggaagggagatgtttcattatgagatcccaggcaaatggcaatatgtttgaggattgtctcctacataaagcagtgtaggtgatttaacctcaaaattgcaaagcaatagttagatgcagaggttagaatttatcatgtaaacaaaaaatccttcaggaaaatgtaagacattgtagtcagtaagcagatgaggtcataggaggccatggctggatcactattagattgcagaaaagaagtcaggggccctctgccaaattgtgcctaaagtccctcagagactgttgattctggtttccccatctacttgtgtgattttacttgcataaaatcacagtgaaagagggaagaatcatctttaaaaagtgattgcataagtagtcctgggtttcagaagatttcagctatcatttacataggaattacttgatttttctaagttactctgatcaaaagggaccactgctttgacaatcaactctaaatacaaacaagaggccaggcgtggtggctcatgcctgtcatcccagcactttgggaggccgaggcgggcggatcatctgagatcaggagttcaagaccagcctgaccaacatggtgaaaccccgtctctactaaaaatacaaaaattagccagtcctggtggtgggcgcctgtagtcccaactactcgggaggctgaggcaggagaatcatttgaacccgggaggcggaggttgcagtgagccgagattgcgccattgcactccagcctgggcaatagagcgagactccatatttaaaaaaaaaaaaaaaaaaaaaagaggaaaacttggtctaacacccttttagttttcttttctctcttcttttcaatctgataggaagaaaccttattctactctagctggtttatgcattcaaagcctttggacatttcttttatgaaccataggcaatgagccttcattctccttggtgatgttttaagttccataaactgagagggaagatgatcttcttaaagtttgcacttccttcagtaggcaagcttgaagccatgttgatatggatatgttttctaaaagtaaccctggaagtgaatataataggaagtaagtgatttcatattgaatttatttgtaaaatggcttagagttttggtgtttgttttttctgaattctgtaatatagaaactggttctctttctccttgtttctcaatgacttttaattacaggtagttctcagacaaatgtaagatacttttctctgtccatttcatgcaaaattcatattcagtatcattcaacaaatctttgaatgacttctatgcatccctgttcatggaacccatgccattagaaaatggcagttgggatgtatgaagaaatgtaggatattctctcaaatcattccctaaattatcctttactgctgcaaatttagctgataaaactgcctttggtttatgcctcttggatcagatatttgacctatgtggaatagattatctctgtgcttccggtttaagacattacgccattttagtggatcatttaaattttttctattctgtttttttttgtttgtttgtttgtttgttttaaacagagtctcactcccgagtagctgggaccacaggcacgtgccatcatgcctggcctatttttgtatttttagtagagatggggtttcaccatgttggccaggcttgtcttgaactcctaacttcagatgacctgcccacatcggcctcccaaagtgctgggattacaggcatgagccaccgtgcctggccaaatttcttctattcttgtaagtgatggtaaaactctggaatcagtccagtattttagtttttcacagcaaatttgattttagtctaccaaggagtttaacttttctatgttccctaactctaagattagggctgtattacctagacaggccttaaaaggtttttgtgttgttctctgttaataagaatttgttcctttaaaccagaggatcaaccttggaactattaacattttgggattgataattcattgttgttgggggctgtcctgtgtgcttaggatgttcagctgcagccctggcctctacccactagattccagtagaccccctcctcagccatgacaacaaagatatctccagacattgccatctgtcccttgggtaggagggtgggaacaaattctcccttagttgtactttttataccaacatcacttgtgtccagggtccatttattttcagtctgtagccatgtgccacttgaattgttatatgagagaaggtgatgtattcagtaatcatggatggaaagaaatggtcactggtattttttgtaatgctcatttttttttttttttgagacagagtctcgctctgttacctaggctggagtgcagtggcgcaatctcagctcactgcaacctccgtctcccgggttcaagcaattcttctgcctccgcctcccaagtagctgggactacaggcacgcgccaccatgcctggctaatttttgtatttttagtacagacggcgtttcaccatattggccaggctggtctcaaactcctgacctcgtgatccgcctgcctcagcctcccaaagtgctgggattacagacgtgagccactgcgactggcttaatgctcattttcataattttcatgtaatattagaaactcagggctggaaggttcaacttctcttttttgaagcagggtctcaacttttatttctaagcattcttgcttatcttaggacagtgattattaacctacctctctgtttctatcaacagaagccaactttatgatagattttgctttgtctctaaagtttaatattttgagtgtactttagaaaataggtcatcattctttaagcgtcattcattgtctaatcacataattttgcagaccatggcagtcattaaatacagaaaaatactgtgtaaaatttgataatcttgtaggaaagttagctgatgtagacatcaattttggatgtgatcagaagaatgtctgcttaagataactggtcaataacttggtatggctactggattcattccacatatggtagtataaggcacttaaatgtgtttcctgattgggcactgtggctcatgcctgtaatcccagcactttgggaggccgtggtgggcagatcacttgaggtcaggagttcgaggccagcctggccaacgtggtgaaaccccatgtctaccaaaaatataaaaagatagccgggcgtggtggcgcatgcctgtaatcccagctactcgggaggctgaggcaggagaattgcttgaacccgggaggcagaggcttcagtgagccgaaatagtgtgactgtactccagcctgggtgacagagtaagtctccgtctcaaaaagaaaaaaaaaaatgtggttcttttgtggaaagaggaatttgaacttgaataaacacttcttttgacaccttttaccagtggtctgaagcagaataaggaagaataagaaatgaatcttgactgttgacttattctgagaattggtgatgtgtaaagagagttggaatcttctacctgggtttttctcagggctaaatggaaaagcacagggcccagaaaggttggagttaatcattcacttaaaagcattaggaggaagtgtcaaagcatcagtcatgaatagattatgtctctctgactacagtcagaccatcaattcactaagaccttatactctgtaagtgttggtaaaggaagaaaactgctaaattgcatgttaccctttactagaaattcattcctttggcacagattttatttatttggggctgtttaatgtgtctgtaaatcatgaaatataaaagcaagattcagtgtagcagagttggtgcttcttctgacaagctaacttgaccatatttctttatctgtgctctaacatgtgtcatattgttttctttttgtaaaccataaaatgggtgaacttccaaaaatcaagggtcatgttttaaaatcatggaacttttagaaataccatatctgtatctctattcctgcattttataaatctgtaaaggaagaaaactgaaaggaagaactagactgagtcttacctttctctgacctaagataaactgataaaactttttacttgatatttggagaagtcattaactggattctagttaatttcccatattgggcagtttagaggagacccagccaaccaaattatgatctagcaaatttaacataggggaagagggatagtaaactatttttcagtagatttgcactttaaacttaggaactggatgttggtggaaaggacttccatagggcagatgggtaaatatctagcctgcacttggatgttagagaatcaaacctcacccttgctcgttctaaacccacatgagtagttaactgtcttttgacataatcagagtcaggatttccctttttccctacttgagtcgtcttccatgtctgttacatccaagatcatccctctgggggatgtgtcaagtagttctcctactcagaatagaagctttgcgaattatcattcccacctctagattttaaatgaatgtagagttgtctaacattatatgggtgggaggctctttgcctctgtgatcagtagggtacctgcctctgaggtgctactgcctggagggatcactcccatcaaaagactggtgagttggaagctaagagcacatgcgcatagccagctcctctcccaggctggcagtcatgattacgagcatcattccagaatctttggcttctagaaccaactccattctgaagaacattttaacatctatgaataccttggtaataatcttttatacacaggagttttgtagcatgactttatgactaaacttattgtgaattaagttatttagaaatgttgagtttctgaatgttattttgtgatttgtttcaaaatggtaataaattgtgttattttgtaaaaaaaaaaaaaagtatatttttggtacatgattattagttttagctaatatagagcaattatataaacttctagtgatattcagtccaaagaaattcagcctttggataacatgtaccatgcagtttgtgtggtgtgtgtgtgtgtgtgtgtgtgtgtgcacgtgcatgagagagagtgaaagagagaggtgttttttgttttgttttttttgagacggagtctcactctgttgcccaggctggagtgcactggcacaatctcggcttactgcaacctccacctcccgtgttcaagcgagtctcctgcctcagcctcccgagtactgggactacaggcgcacaccaccatgcttggctaatttttgtatttttagtagagacgaagtttcaccatgctggccaggttggtctcgaactcttgacctcgtgatctgcccgccacagcctcccaaagagctaggattacaggcacgagccaccgcgcacggccagaggcattcatttctttagctaagtttttttttcttagtaggtttttttctcccaggcttgtaactcttccccagttctttgggcactatttcaaattattaggcttctggaaagagtgcttccagggacagcaagttactactgcacttgaccattcctagtcctcacctgattaccagaaggtacgcaaggtaaaagttagctgataggccctgaattgagaaaaaggaatcaccaagcaatatccgtaacattacacattttgccagcacattttctatgctatcagctaaaacgtaattttggtcacaaaatagggctgtagtgtagtttctacttcttattccagttgtttgattatgaggatacatttcttgctgctgtcctccactaaacagcagacaaattgccaggtgtgctggctcatgcctgtaatcccagtgctttgggaggccaaggcaggagtttgagaccagcctaggcaacatcgtgagaccccatctctacaaaaaaaaaaaaagaaaaaaaaaattagttgggcatggcaatgccgcctgtggtcctagctactggggaggctgaggcaggattgcttgaacccagaagtttgaggttacagtgagctatgatcatgtcactgcaagaccctgtccctaaaaaaaggaaaaacaaatagaagacaaatttcaatttctgagtttatacaaagaaagccttaattcagatcataaatatcccattgttatttttagttcattgtttcctagaacaaaggatggacatttaggatcctcacattgatttatgtcatatatatgtattgcattgaatatatatatacgcatgtagatacatacaattgttatatataattaaaagtcagaatcttaggtgataactgtcagacctctgagcccaagctaagccatcgcatcccctgtgacttgcacgtatacatccagatggcctgaagtaactgaagatccacaaaagaagtaaaaatagccttaactgatgacattccaccattgtgatttgttcctgccccaccctaactgatcaatgtactttgtaatctcccccacccttaagaaggttctttttaattctccccacccttgagaatgtactttgtgagctccacccactgtctgcaaaacattgctcttaacttcagcgcctatcccaaaacctataagaactgatgataatccaccaccctttgctgactctcttttcggactcagcccgcctgcacccaggtgaaataaacagccatgttactcacacaaa

SEQ ID NO: 128572 - DNA, 526 bp, Homo sapiens
  Payload ID: 5165
  Gene Symbol: DNAL1
  Gene Name: dynein, axonemal, light chain 1
  ENST ID: ENST00000554113
  CDS Start-End: 356-526
gcggccgccacgcagtcccacaatgccccgctcgcaccaccctgagggcggagagaaaggaccgctgccggggatagggcttccgccgagagcgccgagaagtgcgcacgcgcactgaccccgcgggccctagcaaccagagcagtgacagtagcaaccgccggaatggaagctttcactgtctacaaactgcattgaaaaaattgccaacctgaatggcttaaaaaacttgaggatattatctttaggaagaaacaacataaagaacttaaatggactggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtg

SEQ ID NO: 128573 - DNA, 639 bp, Homo sapiens
  Payload ID: 5165
  Gene Symbol: DNAL1
  Gene Name: dynein, axonemal, light chain 1
  ENST ID: ENST00000559993
  CDS Start-End: 445-639
gaagagaaaactggccagaggccatctgaagccaaagagataaaactttatgcccagattccccctatagagaagatggatgcatccttgtccatgcttgctaattgcgagaagctttcactgtctacaaactgcattgaaaaaattgccaacctgaatggcttaaaaaacttgaggatattatctttaggaagaaacaacataaagaacttaaatggactgagatggggtttcaccgtagtagccaggatggtctcgatctcctgacctcatgatccgcctgcctcggcctcccaaagtgctgggattacaggcgtgagccaccacacctgggcaaaatttgatatttgtgatgttctaaataaattggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtgcccaaactgaaaaagctggatggt

SEQ ID NO: 128574 - DNA, 1504 bp, Homo sapiens
  Payload ID: 5166
  Gene Symbol: DNAL4
  Gene Name: dynein, axonemal, light chain 4
  Uniprot ID: O96015
  ENST ID: ENST00000216068
  CDS Start-End: 246-563
gggcaggacttccttgctggttgctaagacactcttgtttcgctccttgacaaccctggcgggggttcgctggctgcggccccggctccggcccccgcaggagcagcaccccccggggaaagacattttctgctcccaccgagttggcagggcctgcttcctgaatctcctgggtgtgtcttaactgccagtcccagcacctcctgaaagccccactctcctccagtggtcacagtggaaggatcatgggagaaacagaagggaagaaagatgaggctgattataagcgactgcagaccttccctctggtcaggcactcggacatgccagaggagatgcgcgtggagaccatggagctatgtgtcacagcctgtgagaaattctccaacaacaacgagagcgccgccaagatgatcaaagagacaatggacaagaagttcggctcctcctggcacgtggtgatcggcgagggctttgggtttgagatcacccacgaggtgaagaacctcctctacctgtacttcgggggcaccctggctgtgtgcgtctggaagtgctcctgacactctgtcccctgccccgtcccctgcagggccttttcctgccactcatctggggtggggagcagccctaggcaggtcctggtttttccaaggagagttggggtcttttctttttgtctttgtgtaccagtttcctgagccacgcccagtgtgtgaacttgacatctccatccccaggctctcaaccgtctccctcggagtctcagggtgtggacggggcagcgggcatgggtctgtgtgggagacgtggggtggggcggtgtgacagggtagaggaggtgggagatgagatcttccgcacaggaacacgccagtccccctttctccagggctgccttccccttgcatcctgggagccccactgccctgccatccccagtactgccgggaagtgtcggccgtccttgtcattagtggtcatatgaaaatggccccaagaaggagatgattctttcaagggacacaggcagcttctctccttgtcctctggggaggtgctgacccctcagaaaccccttcccccaacttgaccccaggctgaacagaccactgcatctcactgggccagcagcccccccagcccccagccttggtggggaccaagcagcctttcccgtcccctcctcgacccgtacagttgagagccaggggctggtgtgtgggagctgctacctggcagtttctcgaggggtcaccgagcctctggtgggacacctgggcaggagtgctctcaccacgaggctgcttccgcagggaaccctggcctgcccgcgacttcgcatcagggaccgcatgctgatttgtactgctctctgctgggttttctatgttcttttcgagtgtgggaaaagggttttagtagaagggtgaatcgtattttacacagcggtcttatttatataaatgtcttggtttttacaattaaaatgaccaaaaactga

SEQ ID NO: 128575 - DNA, 631 bp, Homo sapiens
  Payload ID: 5166
  Gene Symbol: DNAL4
  Gene Name: dynein, axonemal, light chain 4
  ENST ID: ENST00000406199
  CDS Start-End: 271-477
aaattctcgtcaacgtccggtgagggggcaggacttccttgctggttgctaagacactcttgtttcgctccttgacaaccctggcgggggttcgctggctgcggccccggctccggcccccgcaggagcagcaccccccggggaaagacattttctgctcccaccgagttggcagggcctgcttcctgaatctcctgggtgtgtcttaactgccagtcccagcacctcctgaaagccccactctcctccagtggtcacagtggaaggatcatgggagaaacagaagggaagaaagatgaggctgattataagcgactgcagaccttccctctggtcaggcactcggacatgccagaggagatgcgcgtggagaccatggagctatgtgtcacagcctgtgagaaattctccaacaacaacgaggtattgccagcagtgcaggcggcccctcgtgcttttgatggcccctgtgggtgaataaagtggcccctgttccctgcagttggctccagacagtactgctaggatgaggccagagccttccttggaagcattcagtctggggaaagtcagtgagtgagaggctggcgctgactccaggcactgacggtcacacccagccctagaggag

SEQ ID NO: 128576 - DNA, 2649 bp, Homo sapiens
  Payload ID: 5167
  Gene Symbol: DNALI1
  Gene Name: dynein, axonemal, light intermediate chain 1
  Uniprot ID: O14645
  ENST ID: ENST00000296218
  CDS Start-End: 11-853
ggcggtttccatggtgacggcaaacaaggcccacactggacagggcagctgctgggttgctactctcgcctccgccatgattccgcccgcagactctttgctcaagtacgacaccccagtgctggtgagccggaacacggagaaacggagccccaaggctcggctactgaaagtcagcccccagcagcctggaccttcaggttcagccccacagccacccaagaccaagctcccctcaactccctgtgtcccagatcctacaaagcaggcagaagaaatcttgaatgccatactacccccaagggagtgggtggaagacacgcagctatggatccagcaggtgtccagcacccctagcaccaggatggacgtggtgcacctccaggagcagttagacttaaagctgcagcagcggcaggccagggaaacaggcatctgccctgtccgcagggaactctactcacagtgttttgatgagttgatccgggaggtcaccatcaactgtgcggagagggggctgctgctgctgcgagtccgggacgagatccgcatgaccatcgctgcctaccagaccctgtacgagagcagcgtggcgtttggcatgaggaaggcactgcaggctgagcaggggaagtcagacatggagaggaaaatcgcagaattggagacggaaaagagagacctggagaggcaagtgaacgagcagaaggcaaaatgtgaagccactgagaagcgggagagcgagaggcggcaggtggaggagaagaagcacaatgaggagattcagttcctgaagcgaacaaatcagcagctgaaggcccaactggaaggcattattgcaccaaagaagtgataatttccacatgattaatttccaacaagacacttgggagttatttactgtgttcctctggcagccaataaaatcatcataagccctttgtaataaaaagctagtttcctgagtgaacaagccataacctcccctaaacaccacctaggtatttgttagaagtcacactattactccaatgtcatcagacacctaaggtctgccagccaggctcctggctgggcaatggaagatggtgtggccctgttagtctccgtgtgtggcttactagccagccttgggaactgccaactcaaattctaagaaagccactgctttctcatcatcactctataccaatacttatttctggccaaatgaatctgcttctctgcccctcaaacttttagttcacaattcatcttctaccttaacttgggcttcttgggcctctggccttccttacttaatgtcttcttttccctactctaatgcatttctaactcactttggagctttggttttctaatgtattatccccacttgccagtcaactggaccccttcctcctcggtttcagactgcctacattaggaaacaatggcagtcaaacccatggctttggagaaagtaaatgtttgccagaaaggaatactagtcacagtggcctttgtgagttgtctgcaactcagctcttcccccagcacagatctgttccccttatcctgcagaaaatcaagccctgactctgcactccccgaagtagtgatgttaattaacaactgaagaggtaactaaatctcacatgcaggtctaatgactaataattggagtacggctgctagacaactgcattttagtatttctcttccattctcctggttttgtagacccagaagattgaatgagtgacataaatctttagttcggggcaagccagggtgggctagggtggtaagctggaggacttcatccttcagttaggctgcacaagtaacattacctaaaaggcactaacatgctcaggttccccagaaagaggcgtaagaagggcctctccttagcagagcttccacctgccatccgtcttgggttcagtgagcttcaaggctcacaatggaagcactgtcatttccccagaaaagctgtgttccctatgctgaacacaccatacacattctcatctggaatctaaggagcagcttttaccctgatccagtatcctgaggaattttaagcctccactcaaatgacctgcctgtgttgtcatttccatgggaaagaactctttccacgagatctgctagttccaggcctctaagacaggaacgtatgtgccataagtgggtctacttcacagactcaatgaggcagaaattattgtagttttctcctatttcttctgcacccaactttctccttgtatttcaaaggccaggccatgtacactaacgtccttgaaatttgcagttctgtatgcttctattccaaatcattcattaccaataaaaacgaaataccaccctttccattttatagacctcatcccctatttctgtcagacagttatatgacagggtgactgtggaacctcttagttcatccaaagtctacctgaagtgctagactttcagactcttatcactgaaatccttaaggttgaggaggctttatttccctagcactggtgaagggcttcaactgtcaaacctcagaacaaatgcattagggccttagaaatgtcaatggggcaggaagaaaacacaatttctaactgcctgtttttgtataatttaataaaaaccttttaaacatta

SEQ ID NO: 128577 - DNA, 14333 bp, Homo sapiens
  Payload ID: 5168
  Gene Symbol: DYNC1H1
  Gene Name: dynein, cytoplasmic 1, heavy chain 1
  Uniprot ID: Q14204
  ENST ID: ENST00000360184
  CDS Start-End: 165-14105
ctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgcgaataccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaatgtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatg

SEQ ID NO: 128578 - DNA, 539 bp, Homo sapiens
  Payload ID: 5168
  Gene Symbol: DYNC1H1
  Gene Name: dynein, cytoplasmic 1, heavy chain 1
  ENST ID: ENST00000553423
  CDS Start-End: 1-539
tcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctga

SEQ ID NO: 128579 - DNA, 2950 bp, Homo sapiens
  Payload ID: 5169
  Gene Symbol: DYNC1I1
  Gene Name: dynein, cytoplasmic 1, intermediate chain 1
  Uniprot ID: O14576
  ENST ID: ENST00000324972
  CDS Start-End: 194-2131
ctgggagagaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggaaaccaacatgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtgcagccgctgcattttttaacatgggatacctgttattttcattatttagtcccaacccctatgtctccctcctcgaaatcagtgagcactcccagtgaagctggaagccaagactcaggcgatctggggccattaacaaggaccctgcagtgggacacagacccctcagtgctccagctgcagtcagactcagaacttggaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagcttgcagttccccacaatgatgaatggacccgatttgccaggacccttgtggaaattcgtgctaacagagctgatagcgaggaggaaggcactgttgagttatctgcctagtggaaatgagccacccccactgcagcccccacctttgtgtcctagagctcagcgtctgcagtcaagtctcttgtattcggtgtccattcagtatcagtattgctgtgatattttgggtgccatattgtgccagctttgctccaagtattctaaatgtgtcccatcatgctttccactgacccaaaattcaccacagcatttctatctttatatttctgtctcaaaaatgaagagaagggggttatgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtacagggccaaagacttgagacgtggtgttttacatggtgactcacattatgaatggatttactagaagaacattgctgctccttatttattgtagtgtgctgcatggaacgtatttatttgaaagcattaaaataaatgatcctagagcatgtgcataatgagaggactgtattctctctgctgctgttgaggttatattaagttccacatagcaattacagtatgccagttccactgaagacatgaaatctttagaggtttcttgcagtgaacgaaatgaattttaatgcctattatttctgggtactttaacaatatttcaaatatcattgaccactaatacttctcactgaagctaacacagtctgacaaaagtctatggttcctaaatatgacatcagtgttgccaataaaa

SEQ ID NO: 128580 - DNA, 2843 bp, Homo sapiens
  Payload ID: 5169
  Gene Symbol: DYNC1I1
  Gene Name: dynein, cytoplasmic 1, intermediate chain 1
  Uniprot ID: O14576
  ENST ID: ENST00000359388
  CDS Start-End: 186-2012
gaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggaaaccaacatgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaagaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagcttgcagttccccacaatgatgaatggacccgatttgccaggacccttgtggaaattcgtgctaacagagctgatagcgaggaggaaggcactgttgagttatctgcctagtggaaatgagccacccccactgcagcccccacctttgtgtcctagagctcagcgtctgcagtcaagtctcttgtattcggtgtccattcagtatcagtattgctgtgatattttgggtgccatattgtgccagctttgctccaagtattctaaatgtgtcccatcatgctttccactgacccaaaattcaccacagcatttctatctttatatttctgtctcaaaaatgaagagaagggggttatgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtacagggccaaagacttgagacgtggtgttttacatggtgactcacattatgaatggatttactagaagaacattgctgctccttatttattgtagtgtgctgcatggaacgtatttatttgaaagcattaaaataaatgatcctagagcatgtgcataatgagaggactgtattctctctgctgctgttgaggttatattaagttccacatagcaattacagtatgccagttccactgaagacatgaaatctttagaggtttcttgcagtgaacgaaatgaattttaatgcctattatttctgggtactttaacaatatttcaaatatcattgaccactaatacttctcactgaagctaacacagtctgacaaaagtctatggttcctaaatatgacatcagtgttgccaataaaatgtttcaaacca

SEQ ID NO: 128581 - DNA, 2947 bp, Homo sapiens
  Payload ID: 5169
  Gene Symbol: DYNC1I1
  Gene Name: dynein, cytoplasmic 1, intermediate chain 1
  Uniprot ID: O14576
  ENST ID: ENST00000447467
  CDS Start-End: 230-2116
agactgagtgctccggggagctgtcagtgtcaggctctgggagagaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggaaaccaacatgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaaggaccctgcagtgggacacagacccctcagtgctccagctgcagtcagactcagaacttggaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagcttgcagttccccacaatgatgaatggacccgatttgccaggacccttgtggaaattcgtgctaacagagctgatagcgaggaggaaggcactgttgagttatctgcctagtggaaatgagccacccccactgcagcccccacctttgtgtcctagagctcagcgtctgcagtcaagtctcttgtattcggtgtccattcagtatcagtattgctgtgatattttgggtgccatattgtgccagctttgctccaagtattctaaatgtgtcccatcatgctttccactgacccaaaattcaccacagcatttctatctttatatttctgtctcaaaaatgaagagaagggggttatgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtacagggccaaagacttgagacgtggtgttttacatggtgactcacattatgaatggatttactagaagaacattgctgctccttatttattgtagtgtgctgcatggaacgtatttatttgaaagcattaaaataaatgatcctagagcatgtgcataatgagaggactgtattctctctgctgctgttgaggttatattaagttccacatagcaattacagtatgccagttccactgaagacatgaaatctttagaggtttcttgcagtgaacgaaatgaattttaatgcctattatttctgggtactttaacaatatttcaaatatcattgaccactaatacttctcactgaagctaacacagtctgacaaaagtctatggttcctaaatatgacatcagtgttgccaataaaatgtttcaaacca

SEQ ID NO: 128582 - DNA, 2895 bp, Homo sapiens
  Payload ID: 5169
  Gene Symbol: DYNC1I1
  Gene Name: dynein, cytoplasmic 1, intermediate chain 1
  Uniprot ID: O14576
  ENST ID: ENST00000437599
  CDS Start-End: 187-2064
agaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggaaaccaacatgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtgcagccgctgcattttttaacatgggatacctgttattttcattatttagtcccaacccctatgtctccctcctcgaaatcagtgagcactcccagtgaagctggaagccaagactcaggcgatctggggccattaacaagaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagcttgcagttccccacaatgatgaatggacccgatttgccaggacccttgtggaaattcgtgctaacagagctgatagcgaggaggaaggcactgttgagttatctgcctagtggaaatgagccacccccactgcagcccccacctttgtgtcctagagctcagcgtctgcagtcaagtctcttgtattcggtgtccattcagtatcagtattgctgtgatattttgggtgccatattgtgccagctttgctccaagtattctaaatgtgtcccatcatgctttccactgacccaaaattcaccacagcatttctatctttatatttctgtctcaaaaatgaagagaagggggttatgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtacagggccaaagacttgagacgtggtgttttacatggtgactcacattatgaatggatttactagaagaacattgctgctccttatttattgtagtgtgctgcatggaacgtatttatttgaaagcattaaaataaatgatcctagagcatgtgcataatgagaggactgtattctctctgctgctgttgaggttatattaagttccacatagcaattacagtatgccagttccactgaagacatgaaatctttagaggtttcttgcagtgaacgaaatgaattttaatgcctattatttctgggtactttaacaatatttcaaatatcattgaccactaatacttctcactgaagctaacacagtctgacaaaagtctatggttcctaaatatgacatcagtgttgccaataaaatgtttcaaacca

SEQ ID NO: 128583 - DNA, 958 bp, Homo sapiens
  Payload ID: 5169
  Gene Symbol: DYNC1I1
  Gene Name: dynein, cytoplasmic 1, intermediate chain 1
  ENST ID: ENST00000413338
  CDS Start-End: 180-530
gtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggaaaccaacatgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaagagacgaagcattgctatattccccaggctggtcttgaacttctggcctcaaatgattctcctccctcttcatcccaaagtggtgggatcctcctgcctctccctcccaaagtgctgagattacaggcaggacccattgtgcccagcctaaaaatctcttactattatagaaacaacacctgtgtattttatacaactagaaaatataaatgagcaaaaataacaaaataaaaacatcatgtttccaccaccagagtagcactcttagcaccttagtgcttattcttttatattatatgtatgtcatcatatataatgataaatgacatcttactgtgaaaactgttgaacctgctttttcaatcaagtgtatttttatatttcaatgtattttcaccttatctagtatctacactatcttcaaatttccccaattggccccaataaaatcctgtagtatttaaaa

SEQ ID NO: 128584 - DNA, 2393 bp, Homo sapiens
  Payload ID: 5169
  Gene Symbol: DYNC1I1
  Gene Name: dynein, cytoplasmic 1, intermediate chain 1
  Uniprot ID: O14576
  ENST ID: ENST00000457059
  CDS Start-End: 101-1987
atatctctaggggtttatgacaggctgttttcttttctcagtgtggggatgaattgctccattatcatctaaattggaagtcatgatgatggaaaccaacatgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaaggaccctgcagtgggacacagacccctcagtgctccagctgcagtcagactcagaacttggaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagcttgcagttccccacaatgatgaatggacccgatttgccaggacccttgtggaaattcgtgctaacagagctgatagcgaggaggaaggcactgttgagttatctgcctagtggaaatgagccacccccactgcagcccccacctttgtgtcctagagctcagcgtctgcagtcaagtctcttgtattcggtgtccattcagtatcagtattgctgtgatattttgggtgccatattgtgccagctttgctccaagtattctaaatgtgtcccatcatgctttccactgacccaaaattcaccacagcatttctatctttatatttctgtctcaaaaatgaagagaagggggttatgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtaca

SEQ ID NO: 128585 - DNA, 540 bp, Homo sapiens
  Payload ID: 5169
  Gene Symbol: DYNC1I1
  Gene Name: dynein, cytoplasmic 1, intermediate chain 1
  ENST ID: ENST00000518089
  CDS Start-End: 155-540
gaaatctccatgcatccgagctcagtggaggaatgtttattgagtccatagaaatttgagcagggcatatctctaggggtttatgacaggctgttttcttttctcagtgtggggatgaattgctccattatcatctaaattggaagaaaccaacatgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaaggaccctgcagtgggacacagacccctcagtgctccagctgcagtcagactcagaacttgggtatatgtctgc

SEQ ID NO: 128586 - DNA, 575 bp, Homo sapiens
  Payload ID: 5169
  Gene Symbol: DYNC1I1
  Gene Name: dynein, cytoplasmic 1, intermediate chain 1
  ENST ID: ENST00000524053
  CDS Start-End: 320-575
agtgtcaggctctgggagagaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccagtctcactctgccacccaggctagagtgcagtgcatgattataactcattgtaaccgtgaattcttggcgtcaagctgtcctcccgcctcagcctcccaaagcactggggttacaggaaaccaacatgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcag

SEQ ID NO: 128587 - DNA, 2146 bp, Homo sapiens
  Payload ID: 5169
  Gene Symbol: DYNC1I1
  Gene Name: dynein, cytoplasmic 1, intermediate chain 1
  ENST ID: ENST00000537881
  CDS Start-End: 512-2146
aggggcgcgggcgtggagggcgtgggcagggggcggggcgagccccgcagactgagtgctccggggagctgtcagtgtcaggctctgggagagaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggaaaccaacatgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaaggaccctgcagtgggacacagacccctcagtgctccagctgcagtcagactcagaacttggaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagggtcttgctatgttgccaggctggtctcaaaattcctggactcaagcaatcctcctatgttggcctcccaaagtgctgggattacagacatga

SEQ ID NO: 128588 - DNA, 2249 bp, Homo sapiens
  Payload ID: 5169
  Gene Symbol: DYNC1I1
  Gene Name: dynein, cytoplasmic 1, intermediate chain 1
  Uniprot ID: O14576
  ENST ID: ENST00000630942
  CDS Start-End: 190-1998
gagagaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggaaaccaacatgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaagaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagggtcttgctatgttgccaggctggtctcaaaattcctggactcaagcaatcctcctatgttggcctcccaaagtgctgggattacagacatgagccactgtgcccagctatgcctgcttgttatatcagctactgagagatgagtaccaaaatctggaagtataattgtggatatcttttagttctttcagttctatcagcttttgttttctgtatccaaagctttgttattaggtgcctacatattgaggatttcatgtgtttgcgatgaactgacccttttatcaatatgaaatgttgctgtttattcctagtaataatcctttttcttaaatctactttga

SEQ ID NO: 128589 - DNA, 2589 bp, Homo sapiens
  Payload ID: 5170
  Gene Symbol: DYNC1I2
  Gene Name: dynein, cytoplasmic 1, intermediate chain 2
  Uniprot ID: Q13409
  ENST ID: ENST00000340296
  CDS Start-End: 229-2067
aattcccagaacgcactgctcgtcgcacgcaggttttccttgttgccggggtttgtagttcttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaa

SEQ ID NO: 128590 - DNA, 2604 bp, Homo sapiens
  Payload ID: 5170
  Gene Symbol: DYNC1I2
  Gene Name: dynein, cytoplasmic 1, intermediate chain 2
  Uniprot ID: Q13409
  ENST ID: ENST00000397119
  CDS Start-End: 168-2084
ttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgttttttctgaatactgggtccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgtt

SEQ ID NO: 128591 - DNA, 2572 bp, Homo sapiens
  Payload ID: 5170
  Gene Symbol: DYNC1I2
  Gene Name: dynein, cytoplasmic 1, intermediate chain 2
  Uniprot ID: Q13409
  ENST ID: ENST00000409197
  CDS Start-End: 212-2050
ttttatttctgggagcgacctcgttctggtgaggctatttgtccctaagctctcgccgtagcagccgccgcccatccctctttgtgtgctttggaaagccgcggagctggtggtggctacagttggtgttgggggcttaggcgagggacgttaccgggaagttgcaggcgggaggactcttccccatccagtcacctgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaa

SEQ ID NO: 128592 - DNA, 2583 bp, Homo sapiens
  Payload ID: 5170
  Gene Symbol: DYNC1I2
  Gene Name: dynein, cytoplasmic 1, intermediate chain 2
  Uniprot ID: Q13409
  ENST ID: ENST00000409773
  CDS Start-End: 140-2056
catccctctttgtgtgctttggaaagccgcggagctggtggtggctacagttggtgttgggggcttaggcgagggacgttaccgggaagttgcaggcgggaggactcttccccatccagtcacctgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgttttttctgaatactgggtccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactttt

SEQ ID NO: 128593 - DNA, 2159 bp, Homo sapiens
  Payload ID: 5170
  Gene Symbol: DYNC1I2
  Gene Name: dynein, cytoplasmic 1, intermediate chain 2
  Uniprot ID: Q13409
  ENST ID: ENST00000410079
  CDS Start-End: 167-2059
tctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgctgagcaacctctccgtgtagtaacagcggatacctgtctatttcactatttagtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaa

SEQ ID NO: 128594 - DNA, 2196 bp, Homo sapiens
  Payload ID: 5170
  Gene Symbol: DYNC1I2
  Gene Name: dynein, cytoplasmic 1, intermediate chain 2
  Uniprot ID: Q13409
  ENST ID: ENST00000409317
  CDS Start-End: 176-2074
atttgtccctaagctctcgccgtagcagccgccgcccatccctctttgtgtgctttggaaagccgcggagctggtggtggctacagttggtgttgggggcttaggcgagggacgttaccgggaagttgcaggcgggaggactcttccccatccagtcacctgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggt

SEQ ID NO: 128595 - DNA, 2552 bp, Homo sapiens
  Payload ID: 5170
  Gene Symbol: DYNC1I2
  Gene Name: dynein, cytoplasmic 1, intermediate chain 2
  Uniprot ID: Q13409
  ENST ID: ENST00000409453
  CDS Start-End: 108-2021
agctggtggtggctacagttggtgttgggggcttaggcgagggacgttaccgggaagttgcaggcgggaggactcttccccatccagtcacctgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgttttttctgaatactgggtccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaacttttcaaa

SEQ ID NO: 128596 - DNA, 741 bp, Homo sapiens
  Payload ID: 5170
  Gene Symbol: DYNC1I2
  Gene Name: dynein, cytoplasmic 1, intermediate chain 2
  ENST ID: ENST00000456808
  CDS Start-End: 179-741
gctatttgtccctaagctctcgccgtagcagccgccgcccatccctctttgtgtgctttggaaagccgcggagctggtggtggctacagttggtgttgggggcttaggcgagggacgttaccgggaagttgcaggcgggaggactcttccccatccagtcacctgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgctgagcaacctctccgtgtagtaacagcggatacctgtctatttcactatttagtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaaga

SEQ ID NO: 128597 - DNA, 808 bp, Homo sapiens
  Payload ID: 5170
  Gene Symbol: DYNC1I2
  Gene Name: dynein, cytoplasmic 1, intermediate chain 2
  ENST ID: ENST00000438879
  CDS Start-End: 166-808
ctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgctgagcaacctctccgtgtagtaacagcggatacctgtctatttcactatttagtccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaag

SEQ ID NO: 128598 - DNA, 622 bp, Homo sapiens
  Payload ID: 5170
  Gene Symbol: DYNC1I2
  Gene Name: dynein, cytoplasmic 1, intermediate chain 2
  ENST ID: ENST00000425485
  CDS Start-End: 66-622
tctcttgagttttaagaacgtgaacatgtcggtcatggaggaaggctctggcttctgtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaaga

SEQ ID NO: 128599 - DNA, 585 bp, Homo sapiens
  Payload ID: 5170
  Gene Symbol: DYNC1I2
  Gene Name: dynein, cytoplasmic 1, intermediate chain 2
  ENST ID: ENST00000423910
  CDS Start-End: 66-585
tctcttgagttttaagaacgtgaacatgtcggtcatggaggaaggctctggcttctgtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgctgagcaacctctccgtgtagtaacagcggatacctgtctatttcactatttagtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctccta

SEQ ID NO: 128600 - DNA, 980 bp, Homo sapiens
  Payload ID: 5170
  Gene Symbol: DYNC1I2
  Gene Name: dynein, cytoplasmic 1, intermediate chain 2
  ENST ID: ENST00000452242
  CDS Start-End: 229-980
aattcccagaacgcactgctcgtcgcacgcaggttttccttgttgccggggtttgtagttcttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaagg

SEQ ID NO: 128601 - DNA, 589 bp, Homo sapiens
  Payload ID: 5170
  Gene Symbol: DYNC1I2
  Gene Name: dynein, cytoplasmic 1, intermediate chain 2
  ENST ID: ENST00000443458
  CDS Start-End: 171-589
gcggtgactcattgcggcccggcgagaggagtccactcctttcccttctcgaccctccagaggcggcctggggagccttgaggcttgtccggcgcccactggcttcttccggacgccctgccgtggaccgcgccctcttggccgtgaccccaggggagaaagtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgttttttctgaatactgggtccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaat

SEQ ID NO: 128602 - DNA, 564 bp, Homo sapiens
  Payload ID: 5170
  Gene Symbol: DYNC1I2
  Gene Name: dynein, cytoplasmic 1, intermediate chain 2
  ENST ID: ENST00000422646
  CDS Start-End: 12-564
aggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagaga

SEQ ID NO: 128603 - DNA, 582 bp, Homo sapiens
  Payload ID: 5170
  Gene Symbol: DYNC1I2
  Gene Name: dynein, cytoplasmic 1, intermediate chain 2
  ENST ID: ENST00000411953
  CDS Start-End: 129-582
gtgtgctttggaaagccgcggagctggtggtggctacagttggtgttgggggcttaggcgagggacgttaccgggaagttgcaggcgggaggactcttccccatccagtcacctgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgctgagcaacctctccgtgtagtaacagcggatacctgtctatttcactatttagtccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaa

SEQ ID NO: 128604 - DNA, 577 bp, Homo sapiens
  Payload ID: 5170
  Gene Symbol: DYNC1I2
  Gene Name: dynein, cytoplasmic 1, intermediate chain 2
  ENST ID: ENST00000412370
  CDS Start-End: 166-577
gactcattgcggcccggcgagaggagtccactcctttcccttctcgaccctccagaggcggcctggggagccttgaggcttgtccggcgcccactggcttcttccggacgccctgccgtggaccgcgccctcttggccgtgaccccaggggagaaagtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgctgagcaacctctccgtgtagtaacagcggatacctgtctatttcactatttagtccctcctcctatgtctccatcctccaaatctgtgagcactccaagtgaagctggaagccaagactctggagatggcgccgtgggatctagacgaggacctattaaacttggaatggctaaaatcacgcaag

SEQ ID NO: 128605 - DNA, 566 bp, Homo sapiens
  Payload ID: 5170
  Gene Symbol: DYNC1I2
  Gene Name: dynein, cytoplasmic 1, intermediate chain 2
  ENST ID: ENST00000430778
  CDS Start-End: 237-566
agttttaagaacgtgaacatgtcggtcatggaggaaggctctggcttctttgacgttgaacaaaatataatgtgcctagcgtagcatacagttacgtatggaagttctcttcaccagccgtttgtatggagctgtttagaggtgtagaaagagtggaataagaaacacggtctcttgcttttagtttgttcaaacaaatcttggaagatattgtgtatatatttcaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctaggacgctgcattgg

SEQ ID NO: 128606 - DNA, 1047 bp, Homo sapiens
  Payload ID: 5170
  Gene Symbol: DYNC1I2
  Gene Name: dynein, cytoplasmic 1, intermediate chain 2
  ENST ID: ENST00000435234
  CDS Start-End: 133-1047
gactgttcttccctcaaggcctccctgcctgtgttccacgtcgcaactcgaagggcggcttggcagttcctgctgacatccccgcccggcccagctttggggaggaaaggcggggagacctgggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgc

SEQ ID NO: 128607 - DNA, 566 bp, Homo sapiens
  Payload ID: 5170
  Gene Symbol: DYNC1I2
  Gene Name: dynein, cytoplasmic 1, intermediate chain 2
  ENST ID: ENST00000445378
  CDS Start-End: 92-457
agttggtgttgggggcttaggcgagggacgttaccgggaagttgcaggcgggaggactcttccccatccagtcacctgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaaca

SEQ ID NO: 128608 - DNA, 2494 bp, Homo sapiens
  Payload ID: 5170
  Gene Symbol: DYNC1I2
  Gene Name: dynein, cytoplasmic 1, intermediate chain 2
  Uniprot ID: Q13409
  ENST ID: ENST00000508530
  CDS Start-End: 137-1972
cggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaa

SEQ ID NO: 128609 - DNA, 2504 bp, Homo sapiens
  Payload ID: 5171
  Gene Symbol: DYNC1LI1
  Gene Name: dynein, cytoplasmic 1, light intermediate chain 1
  Uniprot ID: Q9Y6G9
  ENST ID: ENST00000273130
  CDS Start-End: 105-1676
gtgcgctgaacgccccatatccgggttcccgccgcctccaccgccaccgcctcagccgcctcgcacatttagtcttgccgggagtggtgtgattcccgaccaagatggcggccgtggggcgagtcggctccttcggttcttctccgccgggattatcctcgacttacactggcggccccttgggcaacgagatagcgtcgggcaacggtggcgccgcggcaggcgacgacgaggacgggcagaacctttggtcctgcatcctcagcgaggtctccacccgctcgcgctccaagctccctgcggggaagaacgtgctactgctgggtgaagatggagctggaaaaacaagcttaataagaaaaattcagggaatagaggagtataagaaaggaagaggattggaatatttgtacttaaatgtgcatgatgaagacagggatgatcaaacaagatgtaatgtttggatcttagatggagacctatatcacaaaggcctccttaaattttcactggatgccgtatctctgaaggatactctagttatgctggttgttgacatgtcaaagccttggactgctttggattctttacagaaatgggcaagtgttgttagagaacatgttgacaaactgaaaatccctcctgaagaaatgaaacaaatggaacaaaagttgattagagacttccaagaatatgtagagccaggagaagacttcccggcttctccccagagaagaaatactgcgtcacaagaagacaaagatgacagtgtagttttacctctgggtgcggatacacttacacataacttgggcattccagtactagtagtttgcacaaagtgtgatgccattagtgtattggagaaagaacatgactacagagatgaacattttgattttattcagtcacatatccggaagttttgtttacagtatggtgcagcacttatttacacttcagtaaaagaaaacaaaaatatagacttagtatataaatacatcgttcagaaactatatggatttccctataagattcctgctgttgttgtggaaaaggatgcagtatttattccagcagggtgggataatgataagaaaataggaatattacatgaaaattttcaaacattaaaagcagaagataattttgaagacatcataactaaaccacctgttcgaaagtttgtacatgagaaggaaattatggcagaagatgatcaggtgtttcttatgaagctacagtcccttttagcaaagcaaccaccaactgcagctggaaggcctgtggatgcctcaccaagagtcccaggaggctccccacgaacaccaaatagatctgtatcatctaatgttgccagcgtgtcacccattcctgctgggtcaaaaaaaattgatccaaacatgaaagctggagctacaagtgaaggcgttctggcaaatttcttcaacagtttgttgagtaaaaagactggctctccaggaggccctggtgtgagtggtggtagccctgcaggtggggctggaggtggaagcagtggtttaccaccatccaccaaaaagtcaggccagaagcctgtcttagatgttcatgcagaactagacagaattacacgaaaaccagttacagtttctcccacaacacctacatctcctacggaaggagaagcttcttgaagataccaaataaagccatttattctgttttctgggataatgtaaacatgcctctgccttttccttcaaaagtggaattagaaagctggagtgcttcttcagatggactaaatttatgtcgtgtgtgtgtgtgtgtgtgtgtgtggttacccattttttagaaggagccgtacagaagaaaaattattctacattatgtaggattgctgtttgcattgccattttgcataagaaagtaatttttgattttgaaaatctcaaaacttttagatctgaaatacagccatgtgatcgatcatattctaaaggctatttaaaacatgtaaaaggatttggggaacggcagaaaacatgcagtttgggcatttgactgacttggaagtctaagcttattttagttataactattaaaatcatttttaaaaatttgttagttttgctgacagagaaaaatcgtcagttgtcagattttgcacaccacaataaatgtaccaccacacacggaatatgctaagaaaactatcagatagcgtttgatacactagtcattgtctcaatcactgatcctgtaagttgtcatcaaaatatgatttagaaatattggccaaggtgttgctttaactgaggagaaaagaaagcacactgcctaaatgtgtaaaagaaaaatgcagaggttattaaaatgtaaagaagtaacaatctttggatttgtctatacatatatatatatatatatggctttgccttaatatacccccttttttgtttgtgactttcaactgtaatcagttaataaagtatttattctctgcattcaggttcaaataa

SEQ ID NO: 128610 - DNA, 616 bp, Homo sapiens
  Payload ID: 5171
  Gene Symbol: DYNC1LI1
  Gene Name: dynein, cytoplasmic 1, light intermediate chain 1
  ENST ID: ENST00000413350
  CDS Start-End: 47-616
acagccggcccagccccgccccgcctcgcctcccgacctgtcgcggatggctgggagagaaggggaacacgagacccttgacccaggacctgcggggacccgccctccctcaggtgaagatggagctggaaaaacaagcttaataagaaaaattcagggaatagaggagtataagaaaggaagaggattggaatatttgtacttaaatgtgcatgatgaagacagggatgatcaaacaagatgtaatgtttggatcttagatggagacctatatcacaaaggcctccttaaattttcactggatgccgtatctctgaaggatactctagttatgctggttgttgacatgtcaaagccttggactgctttggattctttacagaaatgggcaagtgttgttagagaacatgttgacaaactgaaaatccctcctgaagaaatgaaacaaatggaacaaaagttgattagagacttccaagaatatgtagagccaggagaagacttcccggcttctccccagagaagaaatactgcgtcacaagaagacaaagatgacagtgtagttttacctctgggtgcggatacacttacacataacttgggcattccagtacta

SEQ ID NO: 128611 - DNA, 1827 bp, Homo sapiens
  Payload ID: 5171
  Gene Symbol: DYNC1LI1
  Gene Name: dynein, cytoplasmic 1, light intermediate chain 1
  ENST ID: ENST00000432458
  CDS Start-End: 89-1312
atatccgggttcccgccgcctccaccgccaccgcctcagccgcctcgcacatttagtcttgccgggagtggtgtgattcccgaccaagatggcggccgtggggcgagtcggctccttcggttcttctccgccgggattatcctcgacttacactggcggccccttgggcaacgagatagcgtcgggcaacggtggcgccgcggcaggcgacgacgaggacgggcagaacctttggtcctgcatcctcagcgaggtctccacccgctcgcgctccaagctccctgcggggaagaacgtgctactgctggtgattagagacttccaagaatatgtagagccaggagaagacttcccggcttctccccagagaagaaatactgcgtcacaagaagacaaagatgacagtgtagttttacctctgggtgcggatacacttacacataacttgggcattccagtactagtagtttgcacaaagtgtgatgccattagtgtattggagaaagaacatgactacagagatgaacattttgattttattcagtcacatatccggaagttttgtttacagtatggtgcagcacttatttacacttcagtaaaagaaaacaaaaatatagacttagtatataaatacatcgttcagaaactatatggatttccctataagattcctgctgttgttgtggaaaaggatgcagtatttattccagcagggtgggataatgataagaaaataggaatattacatgaaaattttcaaacattaaaagcagaagataattttgaagacatcataactaaaccacctgttcgaaagtttgtacatgagaaggaaattatggcagaagatgatcaggtgtttcttatgaagctacagtcccttttagcaaagcaaccaccaactgcagctggaaggcctgtggatgcctcaccaagagtcccaggaggctccccacgaacaccaaatagatctgtatcatctaatgttgccagcgtgtcacccattcctgctgggtcaaaaaaaattgatccaaacatgaaagctggagctacaagtgaaggcgttctggcaaatttcttcaacagtttgttgagtaaaaagactggctctccaggaggccctggtgtgagtggtggtagccctgcaggtggggctggaggtggaagcagtggtttaccaccatccaccaaaaagtcaggccagaagcctgtcttagatgttcatgcagaactagacagaattacacgaaaaccagttacagtttctcccacaacacctacatctcctacggaaggagaagcttcttgaagataccaaataaagccatttattctgttttctgggataatgtaaacatgcctctgccttttccttcaaaagtggaattagaaagctggagtgcttcttcagatggactaaatttatgtcgtgtgtgtgtgtgtgtgtgtgtgtggttacccattttttagaaggagccgtacagaagaaaaattattctacattatgtaggattgctgtttgcattgccattttgcataagaaagtaatttttgattttgaaaatctcaaaacttttagatctgaaatacagccatgtgatcgatcatattctaaaggctatttaaaacatgtaaaaggatttggggaacggcagaaaacatgcagtttgggcatttgactgacttggaagtctaagcttattttagttataactattaaaatcatttttaaaaatttgttagttttgctgacagagaaaaatcgtcagttgtcagattttgcacaccacaataaatgtaccaccacacacggaatatgctaag

SEQ ID NO: 128612 - DNA, 666 bp, Homo sapiens
  Payload ID: 5171
  Gene Symbol: DYNC1LI1
  Gene Name: dynein, cytoplasmic 1, light intermediate chain 1
  ENST ID: ENST00000424991
  CDS Start-End: 89-666
atatccgggttcccgccgcctccaccgccaccgcctcagccgcctcgcacatttagtcttgccgggagtggtgtgattcccgaccaagatggcggccgtggggcgagtcggctccttcggttcttctccgccgggattatcctcgacttacactggcggccccttgggcaacgagatagcgtcgggcaacggtggcgccgcggcaggcgacgacgaggacgggcagaacctttggtcctgcatcctcagcgaggtctccacccgctcgcgctccaagctccctgcggggaagaacgtgctactgctggatggagtttcactcttgttgccccggctagagtgtaatggcaagatttcggctcactgcaacctccacctcctaggttcaagcgattctcctgcctcagcctcctgcgtagctgggattacaggtgaagatggagctggaaaaacaagcttaataagaaaaattcagggaatagaggagtataagaaaggaagaggattggaatatttgtacttaaatgtgcatgatgaagacagggatgatcaaacaagatgtaatgtttggatcttagatggagacctatatcacaaaggcctccttaaattttcactggatgccgtatctctgaaggatactctagttatgctggttgttgacat

SEQ ID NO: 128613 - DNA, 4515 bp, Homo sapiens
  Payload ID: 5172
  Gene Symbol: DYNC1LI2
  Gene Name: dynein, cytoplasmic 1, light intermediate chain 2
  Uniprot ID: O43237
  ENST ID: ENST00000258198
  CDS Start-End: 208-1686
gccgcccgccacctcggcggcctcgcaacccgtgggagcccgtggccatcgcagacctagaggacacgttgggcggcgcagtcgccgcggcaaggtcggcgggcggcgcggcgcgagggacggcgagcggggggcggcccggcccgggtcctcgcgggtcctcggcgggcccgggggagggccctctttgtggctgcagttggcaagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtgggaggcaagcacatctgggcttcttgtggaggggaaggtagagtgaaagaaagagggcccactttctaacagggtggagcaaatgagaccaagaaatcattggtaagatgatggttagtctgaccagtttcatgttagtaaattcacttgttcttgggaagcagattaagtagcagaaagtccaggaaagaaagaccagaaggagtaatgagacaagtgatggtggggaagctgaatgttgagggaggtggaggaaggaggagatgagcagtgtcagtaaatactgtgcattcagtagaagttgaagaatcattgttagaagcatttccaaacaaaacactaagcaaaatgggaattaggcttattttgaatgcatctttaacttacgaaagatgtactaattgtgggggtgcctgagtcaggcggagctgacccaggggtgggaacgatggcagctgcccaggacccatgtgcttggcccaggctatgtcctcgtgagaggtactggggtccacggatatgtgttgtggggcagacagtcactgtgggatgtcttcaaagtcagcagttacagaattagtttactttgaattttgttgtctaaatagctcctgctttattttttaaattaaattttttgtttttactatcacaggctggcctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttcataaaatgtagcattttttttcttatggaaataagagtttcaggtgtctccccacctagggcaaattcatgcacattgtcatgttataccaccattctggaaatgatttctgtggatttgaaattgcacttttaattttatatatgacagcatttaaatgcaaacactaccatgaatttaatgtataaaatgttgtcaaaccaagggaaaaaaccacagttcaccatgtggagtttactttttttatatgaatgtttgttgtactgtgtctaagcataacttccctaatgtcattacttttacataccagatttgactgaccactaatgtagtactggggataacttaatatcctatgttgtgtcaagactctttgaagactttcttgaattgctttcgtaaaggtctgaacactgttaaggagaaagctgagtatcaacttgcctttctgatagaaatgtttcttgtgccagttttattgttgagatatactatttttttccttttttaattcagttttttaaaaaaacaaatgtattgtggcttccagttaccaggttgtctaggtaatgacagtaaactgactgtagaatgataattgtggtatagtgaccaatagatgccaaacagcttgtggcctcactaaaggtggggtcgcttagtccccgggagtaaaatgagtgacctcagaaacaagaattcctggaaaggcacatgccgaagaggaatatggtataattttaaattttaatgcaaaattttaatttgtctttattttttatcatttgaactgataagcactttttgtgtcaatataaaatatactaaaactgatgaaatgctaagacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtatggtagactgttaaagacaattttatgactatttatgcacattataatggttacatctgctttttgtctttaaaataaaaaaaaaaatcagagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgcttacaa

SEQ ID NO: 128614 - DNA, 1502 bp, Homo sapiens
  Payload ID: 5172
  Gene Symbol: DYNC1LI2
  Gene Name: dynein, cytoplasmic 1, light intermediate chain 2
  Uniprot ID: O43237
  ENST ID: ENST00000443351
  CDS Start-End: 11-1258
agttggcaagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtggga

SEQ ID NO: 128615 - DNA, 1145 bp, Homo sapiens
  Payload ID: 5172
  Gene Symbol: DYNC1LI2
  Gene Name: dynein, cytoplasmic 1, light intermediate chain 2
  ENST ID: ENST00000440564
  CDS Start-End: 4-819
aagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatgtgagttattttgagctgatgctttgaaactcttctttttaaagtacatttgctttttacattttaccccttcaaggaaggtgccttctgtctgtgtcttctacagccagctctctcactgcaccttctctctgttcctttccggattatgaggcatctgcctgagggaagtgggtggtgtggtcaggggtgctgcctttcttcctcgagagcaagttgccaaaacctaagccagccatttttggcactcactgtcaactctggtaaaatactggctggggagggaatatagggaattgtgcttgggggatcctgaatgtcttctattaa

SEQ ID NO: 128616 - DNA, 573 bp, Homo sapiens
  Payload ID: 5172
  Gene Symbol: DYNC1LI2
  Gene Name: dynein, cytoplasmic 1, light intermediate chain 2
  ENST ID: ENST00000568180
  CDS Start-End: 11-181
agttggcaagatggcgccggtgggggtggagaagaagctgctgctaggtcccaacgggcccgcggtggcggccgccggcgacctgaccagtgaggaggaggaaggccagagcctatgctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacc

SEQ ID NO: 128617 - DNA, 568 bp, Homo sapiens
  Payload ID: 5172
  Gene Symbol: DYNC1LI2
  Gene Name: dynein, cytoplasmic 1, light intermediate chain 2
  ENST ID: ENST00000566150
  CDS Start-End: 11-568
agttggcaagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctgggg

SEQ ID NO: 128618 - DNA, 641 bp, Homo sapiens
  Payload ID: 5172
  Gene Symbol: DYNC1LI2
  Gene Name: dynein, cytoplasmic 1, light intermediate chain 2
  ENST ID: ENST00000569320
  CDS Start-End: 1-504
gcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacaggaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaa

SEQ ID NO: 128619 - DNA, 563 bp, Homo sapiens
  Payload ID: 5172
  Gene Symbol: DYNC1LI2
  Gene Name: dynein, cytoplasmic 1, light intermediate chain 2
  ENST ID: ENST00000564559
  CDS Start-End: 1-277
cactcccacgagagcttctgaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcagagtcaaggcctcctcctccctgaagctccctacttgtcacatacacacctctgtggcagccacccacctgtccttccatgtaagcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaacttt

SEQ ID NO: 128620 - DNA, 355 bp, Homo sapiens
  Payload ID: 5172
  Gene Symbol: DYNC1LI2
  Gene Name: dynein, cytoplasmic 1, light intermediate chain 2
  ENST ID: ENST00000563628
  CDS Start-End: 1-150
ctggtccacgacaaagagttggcagcagaagatgagcaggtgttcctaatgaagcaacagtcactccttgccaagcaaccagccactcccacgagagcttctgacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtc

SEQ ID NO: 128621 - DNA, 566 bp, Homo sapiens
  Payload ID: 5172
  Gene Symbol: DYNC1LI2
  Gene Name: dynein, cytoplasmic 1, light intermediate chain 2
  ENST ID: ENST00000564090
  CDS Start-End: 11-133
agttggcaagatggcgccggtgggggtggagaagaagctgctgctaggtcccaacgggcccgcggtggcggccgccggcgacctgaccagtgaggaggaggaaggccagagcctatgcccggcccggggctgaccactcttgccattgtcgccacaggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggag

SEQ ID NO: 128622 - DNA, 2984 bp, Homo sapiens
  Payload ID: 5173
  Gene Symbol: DYNC2H1
  Gene Name: dynein, cytoplasmic 2, heavy chain 1
  Uniprot ID: Q8NCM8
  ENST ID: ENST00000334267
  CDS Start-End: 54-2816
ctggtttcttcttccttcccccttcccccaacttccctccaccccttccaatcatggcgaacgggactgcggacgttcggaagctcttcatcttcactactacccagaattacttcgggttgatgtctgaactctgggatcagccactgttgtgcaactgtcttgaaatcaacaacttcttggatgacggcaaccagatgctcctcagggtgcagcgatccgacgcaggaatctccttttccaacacgattgagtttggtgacacaaaagataaagtgctggtgtttttcaagctgcgacctgaagtaattactgatgagaatctacatgataacattcttgtttcatctatgttagagtcacctattagttctctttaccaagcagtacggcaagtattcgcaccaatgttgttaaaggatcaggaatggagcagaaactttgatcccaaacttcagaatcttttgagtgaactagaagctgggttgggtatagttctacgaagatcagacactaacttaacaaaattgaaatttaaggaagatgacacacgaggtatccttacaccaagcgatgagttccagttttggatagaacaagctcaccgtggaaataaacagattagtaaagaaagagccaattattttaaagaattatttgaaacaattgcaagagagttttataacttggacagtctatccttactagaagttgttgacttggtggagactactcaggatgttgtagatgatgtgtggagacaaacagaacatgatcattatcctgagtcacgaatgttgcatctcttagacatcataggtggttcatttggaaggtttgttcagaaaaagttgggaactttgaacctgtgggaagatccttattatcttgtgaaagaaagtctgaaagctggtatttcaatttgtgaacagtgggtgatagtctgtaatcatctaacaggtcaggtgtggcagcgctatgttcctcatccatggaaaaatgaaaaatattttccagaaacacttgacaaacttggcaaacgccttgaagaggtcttggctattagaacaattcatgagaagtttctctattttctacctgccagtgaagagaaaatcatatgcctcactcgagtatttgaaccttttactggcctgaatcctgtgcaatataatccatatactgagcccttgtggaaagctgcggtgtctcaatatgaaaagattattgcacctgcggaacaaaaaatagcaggaaaattgaaaaattatatttcagaaattcaagacagtccacagcagcttcttcaagcattcctgaaatataaagagttggtaaagcgtccaactataagcaaagaattgatgttagaaagagaaactttactggcaagacttgtggactcaattaaagattttcgattagactttgagaatcggtgccgaggaattcctggtgatgcatctggaccactttctggcaaaaatctttcagaagttgtcaacagtatagtttgggttcgccagttggaattgaaggtagatgatactatcaagattgcagaggctcttttatctgacttgccaggatttcgatgtttccatcaaagtgccaaagatctcttagaccagcttaaactatatgaacaggaacaatttgatgattggtccagggatattcaatcaggtttatctgattccagatctggtttgtgtattgaggctagtagtcgaattatggaattggattctaatgatggattactaaaagtgcattattcagatcgtttggtgattcttctgagagaagttcgtcagctctctgcacttggctttgttattcctgccaaaatacagcaagttgcaaacattgcacagaaattctgcaagcaagcaattattcttaaacaagtggcacatttttataattctattgatcaacaaatgattcaaagtcagaggccaatgatgttacaatctgccttagcatttgaacagataattaagaattcaaaagcaggaagtggagggaaatcacagataacttgggataatcctaaagaattagaaggctatatccaaaaactccaaaatgctgctgaacggcttgccactgaaaatagaaaactgagaaaatggcacactacattttgtgaaaaggtggttgttcttatgaatattgatctgcttcggcagcaacagcgctggaaagatggattacaagaattgagaactggcttagcaactgtagaagcacagtgtcctctcgcatggcagagcaagtgggaaggcccagaagatcccttacaatacctgagaggtcttgttgcccgtgcccttgcaatacagaactgggtagataaagctgaaaaacaggctcttctctctgaaacacttgacctatcagaacttttccatccagacacatttcttaatgctcttcgccaggaaactgcaagggcagtgggtcgttctgtggatagccttaaatttgtagcctcatggaaaggtcgactgcaagaagcaaagctacaaattaagatcagtggcttgttactagaaggatgtagttttgatggaaatcaactttctgaaaatcagcttgattctcccagcgtgtcatcagtgctcccttgttttatgggctggattccacaggatgcatgtggtccatattctccggatgagtgcatctctttgcctgtttacacaagtgctgaaagggatcgtgtggttaccaatattgatgttccatgtgggggcaaccaagaccagtggattcagtgtggagcagctctattcctaaaaaatcagtagaatctaatgacaacaaaagccatcttcacaaaagggaacattgattctttaagctttaaatcaaacatgtggtcagtctacatttgaaatgttagttcaaaatattaacatatagttatgttgttgatgtcactgaaattttaatgtgtaaaagcagcactgtgcatc

SEQ ID NO: 128623 - DNA, 13678 bp, Homo sapiens
  Payload ID: 5173
  Gene Symbol: DYNC2H1
  Gene Name: dynein, cytoplasmic 2, heavy chain 1
  Uniprot ID: Q8NCM8
  ENST ID: ENST00000375735
  CDS Start-End: 145-13068
gactacccctggcaaccgcgaagctctgcggtcccgcggtcgggctacgggtttgagcaaagctcctctcttcccttcacttccctccggactggtttcttcttccttcccccttcccccaacttccctccaccccttccaatcatggcgaacgggactgcggacgttcggaagctcttcatcttcactactacccagaattacttcgggttgatgtctgaactctgggatcagccactgttgtgcaactgtcttgaaatcaacaacttcttggatgacggcaaccagatgctcctcagggtgcagcgatccgacgcaggaatctccttttccaacacgattgagtttggtgacacaaaagataaagtgctggtgtttttcaagctgcgacctgaagtaattactgatgagaatctacatgataacattcttgtttcatctatgttagagtcacctattagttctctttaccaagcagtacggcaagtattcgcaccaatgttgttaaaggatcaggaatggagcagaaactttgatcccaaacttcagaatcttttgagtgaactagaagctgggttgggtatagttctacgaagatcagacactaacttaacaaaattgaaatttaaggaagatgacacacgaggtatccttacaccaagcgatgagttccagttttggatagaacaagctcaccgtggaaataaacagattagtaaagaaagagccaattattttaaagaattatttgaaacaattgcaagagagttttataacttggacagtctatccttactagaagttgttgacttggtggagactactcaggatgttgtagatgatgtgtggagacaaacagaacatgatcattatcctgagtcacgaatgttgcatctcttagacatcataggtggttcatttggaaggtttgttcagaaaaagttgggaactttgaacctgtgggaagatccttattatcttgtgaaagaaagtctgaaagctggtatttcaatttgtgaacagtgggtgatagtctgtaatcatctaacaggtcaggtgtggcagcgctatgttcctcatccatggaaaaatgaaaaatattttccagaaacacttgacaaacttggcaaacgccttgaagaggtcttggctattagaacaattcatgagaagtttctctattttctacctgccagtgaagagaaaatcatatgcctcactcgagtatttgaaccttttactggcctgaatcctgtgcaatataatccatatactgagcccttgtggaaagctgcggtgtctcaatatgaaaagattattgcacctgcggaacaaaaaatagcaggaaaattgaaaaattatatttcagaaattcaagacagtccacagcagcttcttcaagcattcctgaaatataaagagttggtaaagcgtccaactataagcaaagaattgatgttagaaagagaaactttactggcaagacttgtggactcaattaaagattttcgattagactttgagaatcggtgccgaggaattcctggtgatgcatctggaccactttctggcaaaaatctttcagaagttgtcaacagtatagtttgggttcgccagttggaattgaaggtagatgatactatcaagattgcagaggctcttttatctgacttgccaggatttcgatgtttccatcaaagtgccaaagatctcttagaccagcttaaactatatgaacaggaacaatttgatgattggtccagggatattcaatcaggtttatctgattccagatctggtttgtgtattgaggctagtagtcgaattatggaattggattctaatgatggattactaaaagtgcattattcagatcgtttggtgattcttctgagagaagttcgtcagctctctgcacttggctttgttattcctgccaaaatacagcaagttgcaaacattgcacagaaattctgcaagcaagcaattattcttaaacaagtggcacatttttataattctattgatcaacaaatgattcaaagtcagaggccaatgatgttacaatctgccttagcatttgaacagataattaagaattcaaaagcaggaagtggagggaaatcacagataacttgggataatcctaaagaattagaaggctatatccaaaaactccaaaatgctgctgaacggcttgccactgaaaatagaaaactgagaaaatggcacactacattttgtgaaaaggtggttgttcttatgaatattgatctgcttcggcagcaacagcgctggaaagatggattacaagaattgagaactggcttagcaactgtagaagcacagggattccaagcaagtgacatgcatgcatggaaacaacactggaatcatcaactgtacaaagctctggagcatcagtaccagatgggcttagaagcacttaatgagaatttgccagaaataaatatagacttaacttacaaacagggacgattacaattcaggcccccttttgaagaaatccgggctaaatattatagagaaatgaagagattcatcggcattccaaatcagtttaagggagtgggtgaggcaggagatgaatctattttttctattatgattgatagaaatgcaagtggatttttgacgattttcagcaaagcagaagatctgtttagaagattgtcagctgttttacaccaacataaggaatggattgtaattgggcaagttgatatggaagctctggtggaaaagcatctttttactgtacatgattgggagaaaaattttaaagcattaaaaataaaggggaaagaagtagaacgacttccaagtgctgtcaaggtagattgtttaaatattaattgcaaccctgtgaagactgtgattgatgatctcatccagaagttatttgatctgcttgttctttctttgaagaagtccatacaggctcatttacatgaaattgatacatttgttactgaggctatggaagtcttaacaattatgccccagtctgtggaagaaattggtgatgcaaatctacaatatagtaagttacaagaacggaagccagagattttgcccttatttcaagaagctgaagacaaaaacagacttttacgaactgtggctggtggaggtttagaaacaattagtaatttgaaagccaagtgggataaatttgagttaatgatggaaagtcaccaacttatgattaaagaccagattgaagtgatgaaaggaaatgtgaaatcacgtcttcagatctattatcaagaactggaaaaatttaaagctcgttgggaccaactaaagcctggtgatgatgttattgaaactggccaacataatactcttgataaaagtgcaaagttaataaaagagaaaaaaattgagtttgatgatcttgaagtcacaagaaaaaagctggttgatgattgccatcattttagactggaagagcctaatttctccctggcaagtagtatctctaaagatatcgagagctgtgcccaaatttgggccttttatgaagagtttcaacaaggatttcaggaaatggccaatgaagactggatcacttttcggactaagacatacctgtttgaggaatttttgatgaactggcatgacagattaaggaaggttgaagaacattcagtgatgacagtgaaattacaatcagaggttgacaaatataaaatcgtaattcctatcttgaaatatgtgagaggggagcatctttctccagatcactggcttgacctttttcgtctccttggacttcctagggggactagtctagagaaactactgtttggtgatttgctcagagtagctgatacaattgtagccaaagctgccgaccttaaagatttaaatagtcgggcacaaggtgaagttacaatcagagaagctttacgtgaacttgatctttggggagttggagcagtgtttacattaattgattatgaagacagccaaagtcgaactatgaagctgattaaagactggaaagatatagtaaatcaggttggagataatagatgccttctccaatccttaaaggattctccttattataaaggatttgaagataaagtatcaatttgggaaagaaaacttgcagagttagatgaatacctgcagaatttaaatcatattcagagaaagtgggtgtatttggaacccattttcggccgtggagcattgccaaaagaacagacacgcttcaacagagttgatgaagattttagatcaataatgactgatatcaagaaagacaatagagtcacaacattaactactcatgctggaataagaaattctctactaacaatacttgatcagcttcaaagatgtcagaaatcattaaatgaatttttggaggaaaaacgctcagcattcccaagattttattttattggtgatgatgacttattagaaatattgggccagtctaccaacccatcagtgattcagtctcacctgaagaagctttttgctggtattaacagtgtttgctttgatgagaaatcaaaacatataactgcaatgaaatctttagagggagaagttgtaccttttaaaaataaagttcctctatcaaataatgtagagacatggttgaatgatttggccttagaaatgaagaaaactttggaacagttgttgaaggaatgtgttactactgggcgaagttctcaaggtgcagttgacccatctctgttcccttcacagattttatgcttggcggagcagattaaattcactgaagatgtagaaaatgctattaaagatcatagtcttcatcagattgaaacacaactggtgaataagttagagcaatatactaacattgatacaagttctgaggatccagggaatactgaatcgggcatcctggagcttaaacttaaagccctaattcttgacattatccataatattgatgtggtaaagcagttaaaccaaattcaggttcatacaactgaagactgggcttggaaaaaacaacttagattctatatgaaaagtgatcatacatgttgtgttcaaatggtggattctgaatttcagtatacttatgaatatcagggtaatgcttccaaactggtttatactccactgacagacaagtgctacttaactctcactcaagccatgaagatgggacttggaggaaatccttatggaccagctggaactgggaaaacggaatcagtaaaggctttaggtggacttcttggaagacaagttttagtctttaattgtgatgagggcatcgatgtgaagtcaatgggacgaatatttgttggtttggtgaagtgtggggcctggggttgttttgatgaatttaataggctggaagaatctgtactgtcagcagtttctatgcaaatccagacaattcaagatgctttgaagaatcatagaactgtatgtgaactgcttggcaaggaggtagaagtaaattctaattctggaatttttatcactatgaatcctgctggaaaaggttatggaggaagacaaaaactgcctgataatcttaaacagcttttcaggcccgtagctatgtctcatccagacaatgagcttattgcagaagttattctctattcggaaggctttaaagacgctaaagtattgagcagaaaattggtagctattttcaatctatctagggaacttttgacacctcagcaacattatgattggggtttgagagctttgaagacagttctgagaggaagtggaaatctccttagacagctaaacaaaagtggcactacacagaatgctaatgaaagtcatattgtggtacaagcactgaggcttaataccatgtcaaagtttacgtttactgattgcacccggtttgatgcactgataaaagatgtctttccgggaattgaattgaaagaagtggaatatgatgaactaagtgctgcattaaagcaggtctttgaagaggccaattatgaaattatacccaatcagatcaaaaaggctttagaattgtatgaacagttatgccagaggatgggagttgttattgttggtccaagtggtgctggaaaatcaacgctttggagaatgttaagggctgcgctttgtaaaactggcaaagtagtgaaacaatatactatgaatcccaaagctatgcctcgatatcaattattaggccatattgacatggacacaagagaatggtctgatggtgttttgacaaatagtgctcgtcaagtggttcgggaacctcaagatgtcagctcatggataatctgtgatggtgatattgaccctgaatggatagaatctctgaattctgttctggatgataatcgactgctgactatgcccagtggagaaaggattcagtttggcccaaatgttaactttgtatttgaaactcatgatttaagttgtgcatcaccagccacaatatctagaatgggaatgatctttcttagtgatgaagagacagatcttaattctctgataaaatcttggttgaggaatcagcctgctgaatatagaaataatcttgaaaattggattggagattattttgaaaaggctttacaatgggttctaaagcagaatgactatgtggtagaaacaagtttggttgggactgtgatgaatggtttgtcacatctacatggttgcagagatcatgacgaattcattattaatctcataaggggacttggtggaaatctgaatatgaagtcacgtttggaatttaccaaagaggtttttcattgggcacgagaatctcctccagactttcacaaacctatggatacctactatgactctactaggggtcgattagcaacatatgtgcttaagaagccagaagacttgactgctgatgatttcagtaacggcttaactcttccagtcattcagactcctgacatgcaacgaggtctagattatttcaaaccatggttaagttctgatactaaacagccctttattctggtaggaccagaaggatgtggcaaagggatgctgctcaggtacgcattttcacaactccggtccactcaaattgctacagttcactgtagtgcacaaaccacttctcgacatctcctgcagaaactgagccagacttgcatggtaatcagtactaatactggtcgtgtatacagaccaaaagactgtgaaagacttgttctgtacttaaaagatatcaacctacctaaacttgataaatgggggaccagtactttggtagcattcctacaacaggtattgacgtatcaaggattttatgatgaaaatttggaatgggttggtctagaaaatattcaaattgtggcttctatgtcagctggaggaagactgggaagacataaacttactaccagatttacttccatcgttcgtctttgttctatagattacccagaaagagagcagttacaaacgatttatggagcatatttggaaccagttctacataaaaatctgaagaatcattctatttggggttcttcatcaaaaatttatcttttagcaggatctatggtacaagtgtatgaacaggtgcgagccaaatttacagttgatgattatagtcactatttctttactccttgcattcttacccaatgggttcttggcttatttagatatgatttagaaggaggatcctcaaaccatccactagattatgtgttagaaattgtagcatatgaggcacggcgcttatttcgtgacaaaattgttggtgcaaaggaacttcatttatttgacatcattttaacatcagtgtttcaaggagattggggctcagacatattagacaatatgtcagatagtttctacgttacatggggagctcggcataattcaggagcaagggcagccccaggacaaccattacctccacatggaaaaccacttggaaaactaaactctactgatctcaaggatgttattaaaaagggtcttattcattatggacgagataaccagaatttagacattttacttttccacgaagtcttggagtatatgtctaggatagatagagtgctgagtttccctggaggttcacttctattagcaggacgcagtggtgtaggtcgtcggaccatcacttctttagtcagtcacatgcatggagcggtcctgttttctccaaagatttccagaggatatgaactgaagcagttcaaaaatgatctcaaacatgtgctgcaacttgcaggaattgaagcacaacaggtagttttacttcttgaggattaccagtttgtacatcctacatttttggagatgatcaatagccttttgtcttcaggtgaagttcctggactctatactcttgaagaattagagcccttgctgttaccacttaaggatcaagcttcacaagatggtttttttggaccagtcttcaattacttcacatatagaattcagcaaaacttgcatattgtcttgataatggattctgcaaattcaaacttcatgataaactgtgagagtaatccagctttgcataagaaatgccaggtgttgtggatggagggttggtccaatagcagtatgaagaaaatacctgaaatgttattcagtgaaacaggtggtggagaaaaatacaatgataaaaaacgaaaagaagaaaagaaaaaaaattcagttgatcctgattttctaaaatcatttttattaatccatgaatcttgtaaagcatatggtgctacaccaagccgatacatgacctttttacatgtgtattctgccattagtagtagcaagaaaaaggaattattaaaaagacaaagtcatttgcaggctggtgtatctaaactaaatgaagctaaagctcttgtggatgaactgaacagaaaagctggagaacaaagtgtgttacttaaaacgaagcaagatgaagcagatgctgcccttcaaatgatcacagtgtcaatgcaggatgctagtgagcaaaaaacagaacttgaaagactgaagcacagaatagcagaagaagttgttaaaattgaagaaagaaaaaataaaattgatgatgaattaaaagaagtacaacctttagtcaatgaagctaaactagcagttggaaacattaagcccgaatcactttcagaaattcgctcactacgcatgccacctgatgtaattagagatattcttgaaggagttttaaggttgatgggtatctttgatacatcttgggtgagcatgaaaagtttccttgcaaaaagaggtgtaagagaagacatagcaacctttgatgcccgaaatatttcaaaggaaataagagagagtgttgaagaacttctttttaaaaataaaggctcttttgatccaaagaatgctaagcgtgccagtactgcagctgcacctttggctgcctgggtgaaagccaatattcagtattcccatgtcttggaacgaattcatcctttggaaactgaacaggcaggattagaatcgaatctgaagaaaactgaagacagaaaaaggaaactagaggagcttcttaattctgttggtcaaaaggtatcagaactcaaagaaaaatttcagagcaggacttcagaagctgccaaacttgaggctgaagtaagcaaggcacaagaaacaatcaaagctgcagaagtcttaattaatcagcttgacagagaacataagagatggaatgcacaggttgtagagataacagaggaattagctactcttcctaaaagagctcaacttgctgctgcatttattacatatctttctgctgctcctgaatctctgagaaaaacctgtttggaagaatggaccaagtcagctggtcttgagaaatttgatctgaggagatttctttgtactgaaagtgagcagttaatttggaaaagtgaaggcctaccatcagatgacctttccatagaaaatgctcttgtaatattacagagtcgagtgtgcccatttcttatagatccttcttcccaagctacagagtggttaaaaacacatttgaaagactcacgtttagaagttatcaatcagcaggatagtaactttatcacagctcttgaattagcagtacgttttgggaaaacccttattatacaagagatggatggtgtagaacctgttctttatccattattgagacgagatctggttgctcaaggaccacgttatgtggtacaaataggtgacaaaattattgactacaatgaagaattccgcctctttttgtcaacaagaaacccaaatccttttattccaccggatgcagcttccattgttactgaggttaactttactacaacaagaagtggattacgagggcagcttttagctttaaccattcagcatgagaaacctgatttagaagaacagaaaacaaaactattacaacaggaagaagataagaaaatacagctagccaagctcgaagaatctcttctagagacacttgccacatctcaaggcaatattttggaaaataaggatttgattgagtctttgaatcagacaaaagcaagcagtgcacttattcaagagtcacttaaagaatcttacaaactccaaatttcccttgatcaagaacgggatgcctatctccccctggctgagagtgccagcaagatgtacttcattatttctgatttgtccaaaattaataacatgtaccgttttagtttggctgcttttctccgacttttccaacgagctctacaaaacaaacaggattctgaaaatacagaacagagaatccagtcacttatcagctcattacaacatatggtatatgaatatatatgtcgttgtctatttaaggctgatcagttgatgttcgctttgcattttgttcgaggcatgcatcctgaactttttcaagaaaatgaatgggatacgtttacaggtgtggttgttggagacatgttacggaaagctgactctcaacaaaaaatacgtgatcagcttccgtcttggatagatcaggaacgaagctgggccgtggcaacattaaagattgctctccccagtctttatcagaccctctgctttgaagatgcagctctgtggcgtacttattataataattcaatgtgtgagcaagagtttccatctatccttgcaaagaaagtttccttatttcagcagattcttgtagtacaggcgctaagaccggacagattgcaaagtgccatggctctttttgcatgtaaaactctgggactgaaagaggtgtccccactgcctctaaatctcaaacgtttatacaaagagacactggaaattgaacccatcttgataattatttctccgggtgctgatccttctcaggaacttcaagaactagctaatgctgaaagaagcggagagtgttatcaccaggttgccatgggtcaaggtcaagctgatttagcaattcaaatgctaaaagaatgtgcccgcaatggagactggctctgtttgaagaacttacatcttgtggtatcttggctgccagttctggaaaaggaattgaatactcttcaacctaaagatacctttcgtctttggctcactgcagaagttcatcccaactttactcctattttactacagtcaagtctgaagataacatatgagtcacctccaggtttaaagaagaatttaatgcgtacttatgagtcttggactcctgagcaaattagcaaaaaagataatacacatcgagctcatgctctcttcagtcttgcatggtttcatgctgcatgtcaagaaagaagaaactatattcctcagggttggacaaagttttatgaattttctttatcagatcttcgggctgggtacaacattattgacagactttttgatggtgccaaagatgtacaatgggaatttgtacatggtttacttgaaaatgctatttatggaggacgtatagacaactattttgaccttagagttcttcagtcatacctgaagcagttttttaattcttcagttattgatgtattcaaccaaaggaacaagaaaagcatttttccatattccgtatctctaccacaatcctgcagcattttggactatcgtgctgtcattgagaaaattccagaggacgacaaacctagtttctttggtctgcctgccaatatcgctcgctcatctcagcgcatgatcagttctcaggttatttcacagttgaggattttgggcagatccataacagctggttccaaatttgatagagaaatctggtctaatgaactttctcctgtcctcaatctctggaagaaactaaaccagaattcaaacctaatacatcagaaagtgcctcctcctaacgatcgacaaggatctccaatactgtcattcatcattcttgaacaatttaatgctattcgtttagtacaaagtgtccaccagtctcttgctgctctcagcaaagtcatcagaggaactactttactgagttcagaagtacaaaaattggcaagtgctttattaaaccaaaagtgtcctctcgcatggcagagcaagtgggaaggcccagaagatcccttacaatacctgagaggtcttgttgcccgtgcccttgcaatacagaactgggtagataaagctgaaaaacaggctcttctctctgaaacacttgacctatcagaacttttccatccagacacatttcttaatgctcttcgccaggaaactgcaagggcagtgggtcgttctgtggatagccttaaatttgtagcctcatggaaaggtcgactgcaagaagcaaagctacaaattaagatcagtggcttgttactagaaggatgtagttttgatggaaatcaactttctgaaaatcagcttgattctcccagcgtgtcatcagtgctcccttgttttatgggctggattccacaggatgcatgtggtccatattctccggatgagtgcatctctttgcctgtttacacaagtgctgaaagggatcgtgtggttaccaatattgatgttccatgtgggggcaaccaagaccagtggattcagtgtggagcagctctattcctaaaaaatcagtagaatctaatgacaacaaaagccatcttcacaaaagggaacattgattctttaagctttaaatcaaacatgtggtcagtctacatttgaaatgttagttcaaaatattaacatatagttatgttgttgatgtcactgaaattttaatgtgtaaaagcagcactgtgcatcttttaaagtaataaattaatggagttattgttaaaacagagtattcttttgacaacattaaatatttctgtgagaaagttcacttttccagtggctcaaaaatttgttttaggtcagagattttaagtggtatattaaccaataataaatattttggctgtcatttgtgtcataattatttaataaaagagcattcataatttttgcagtcttcccatgactctttttacatactgaagaatgtattataaagttataatgaatgtataaaagtatcaacatgaatataattatactatgctaattataatatacaaatatataattattgtcataattatatacttataactaatatcttaaggtaattcaaataggaataattcaggtgacataataatggaggataaattctggttattaaacattcagcttttttgtg

SEQ ID NO: 128624 - DNA, 12945 bp, Homo sapiens
  Payload ID: 5173
  Gene Symbol: DYNC2H1
  Gene Name: dynein, cytoplasmic 2, heavy chain 1
  Uniprot ID: Q8NCM8
  ENST ID: ENST00000398093
  CDS Start-End: 1-12945
atggcgaacgggactgcggacgttcggaagctcttcatcttcactactacccagaattacttcgggttgatgtctgaactctgggatcagccactgttgtgcaactgtcttgaaatcaacaacttcttggatgacggcaaccagatgctcctcagggtgcagcgatccgacgcaggaatctccttttccaacacgattgagtttggtgacacaaaagataaagtgctggtgtttttcaagctgcgacctgaagtaattactgatgagaatctacatgataacattcttgtttcatctatgttagagtcacctattagttctctttaccaagcagtacggcaagtattcgcaccaatgttgttaaaggatcaggaatggagcagaaactttgatcccaaacttcagaatcttttgagtgaactagaagctgggttgggtatagttctacgaagatcagacactaacttaacaaaattgaaatttaaggaagatgacacacgaggtatccttacaccaagcgatgagttccagttttggatagaacaagctcaccgtggaaataaacagattagtaaagaaagagccaattattttaaagaattatttgaaacaattgcaagagagttttataacttggacagtctatccttactagaagttgttgacttggtggagactactcaggatgttgtagatgatgtgtggagacaaacagaacatgatcattatcctgagtcacgaatgttgcatctcttagacatcataggtggttcatttggaaggtttgttcagaaaaagttgggaactttgaacctgtgggaagatccttattatcttgtgaaagaaagtctgaaagctggtatttcaatttgtgaacagtgggtgatagtctgtaatcatctaacaggtcaggtgtggcagcgctatgttcctcatccatggaaaaatgaaaaatattttccagaaacacttgacaaacttggcaaacgccttgaagaggtcttggctattagaacaattcatgagaagtttctctattttctacctgccagtgaagagaaaatcatatgcctcactcgagtatttgaaccttttactggcctgaatcctgtgcaatataatccatatactgagcccttgtggaaagctgcggtgtctcaatatgaaaagattattgcacctgcggaacaaaaaatagcaggaaaattgaaaaattatatttcagaaattcaagacagtccacagcagcttcttcaagcattcctgaaatataaagagttggtaaagcgtccaactataagcaaagaattgatgttagaaagagaaactttactggcaagacttgtggactcaattaaagattttcgattagactttgagaatcggtgccgaggaattcctggtgatgcatctggaccactttctggcaaaaatctttcagaagttgtcaacagtatagtttgggttcgccagttggaattgaaggtagatgatactatcaagattgcagaggctcttttatctgacttgccaggatttcgatgtttccatcaaagtgccaaagatctcttagaccagcttaaactatatgaacaggaacaatttgatgattggtccagggatattcaatcaggtttatctgattccagatctggtttgtgtattgaggctagtagtcgaattatggaattggattctaatgatggattactaaaagtgcattattcagatcgtttggtgattcttctgagagaagttcgtcagctctctgcacttggctttgttattcctgccaaaatacagcaagttgcaaacattgcacagaaattctgcaagcaagcaattattcttaaacaagtggcacatttttataattctattgatcaacaaatgattcaaagtcagaggccaatgatgttacaatctgccttagcatttgaacagataattaagaattcaaaagcaggaagtggagggaaatcacagataacttgggataatcctaaagaattagaaggctatatccaaaaactccaaaatgctgctgaacggcttgccactgaaaatagaaaactgagaaaatggcacactacattttgtgaaaaggtggttgttcttatgaatattgatctgcttcggcagcaacagcgctggaaagatggattacaagaattgagaactggcttagcaactgtagaagcacagggattccaagcaagtgacatgcatgcatggaaacaacactggaatcatcaactgtacaaagctctggagcatcagtaccagatgggcttagaagcacttaatgagaatttgccagaaataaatatagacttaacttacaaacagggacgattacaattcaggcccccttttgaagaaatccgggctaaatattatagagaaatgaagagattcatcggcattccaaatcagtttaagggagtgggtgaggcaggagatgaatctattttttctattatgattgatagaaatgcaagtggatttttgacgattttcagcaaagcagaagatctgtttagaagattgtcagctgttttacaccaacataaggaatggattgtaattgggcaagttgatatggaagctctggtggaaaagcatctttttactgtacatgattgggagaaaaattttaaagcattaaaaataaaggggaaagaagtagaacgacttccaagtgctgtcaaggtagattgtttaaatattaattgcaaccctgtgaagactgtgattgatgatctcatccagaagttatttgatctgcttgttctttctttgaagaagtccatacaggctcatttacatgaaattgatacatttgttactgaggctatggaagtcttaacaattatgccccagtctgtggaagaaattggtgatgcaaatctacaatatagtaagttacaagaacggaagccagagattttgcccttatttcaagaagctgaagacaaaaacagacttttacgaactgtggctggtggaggtttagaaacaattagtaatttgaaagccaagtgggataaatttgagttaatgatggaaagtcaccaacttatgattaaagaccagattgaagtgatgaaaggaaatgtgaaatcacgtcttcagatctattatcaagaactggaaaaatttaaagctcgttgggaccaactaaagcctggtgatgatgttattgaaactggccaacataatactcttgataaaagtgcaaagttaataaaagagaaaaaaattgagtttgatgatcttgaagtcacaagaaaaaagctggttgatgattgccatcattttagactggaagagcctaatttctccctggcaagtagtatctctaaagatatcgagagctgtgcccaaatttgggccttttatgaagagtttcaacaaggatttcaggaaatggccaatgaagactggatcacttttcggactaagacatacctgtttgaggaatttttgatgaactggcatgacagattaaggaaggttgaagaacattcagtgatgacagtgaaattacaatcagaggttgacaaatataaaatcgtaattcctatcttgaaatatgtgagaggggagcatctttctccagatcactggcttgacctttttcgtctccttggacttcctagggggactagtctagagaaactactgtttggtgatttgctcagagtagctgatacaattgtagccaaagctgccgaccttaaagatttaaatagtcgggcacaaggtgaagttacaatcagagaagctttacgtgaacttgatctttggggagttggagcagtgtttacattaattgattatgaagacagccaaagtcgaactatgaagctgattaaagactggaaagatatagtaaatcaggttggagataatagatgccttctccaatccttaaaggattctccttattataaaggatttgaagataaagtatcaatttgggaaagaaaacttgcagagttagatgaatacctgcagaatttaaatcatattcagagaaagtgggtgtatttggaacccattttcggccgtggagcattgccaaaagaacagacacgcttcaacagagttgatgaagattttagatcaataatgactgatatcaagaaagacaatagagtcacaacattaactactcatgctggaataagaaattctctactaacaatacttgatcagcttcaaagatgtcagaaatcattaaatgaatttttggaggaaaaacgctcagcattcccaagattttattttattggtgatgatgacttattagaaatattgggccagtctaccaacccatcagtgattcagtctcacctgaagaagctttttgctggtattaacagtgtttgctttgatgagaaatcaaaacatataactgcaatgaaatctttagagggagaagttgtaccttttaaaaataaagttcctctatcaaataatgtagagacatggttgaatgatttggccttagaaatgaagaaaactttggaacagttgttgaaggaatgtgttactactgggcgaagttctcaaggtgcagttgacccatctctgttcccttcacagattttatgcttggcggagcagattaaattcactgaagatgtagaaaatgctattaaagatcatagtcttcatcagattgaaacacaactggtgaataagttagagcaatatactaacattgatacaagttctgaggatccagggaatactgaatcgggcatcctggagcttaaacttaaagccctaattcttgacattatccataatattgatgtggtaaagcagttaaaccaaattcaggttcatacaactgaagactgggcttggaaaaaacaacttagattctatatgaaaagtgatcatacatgttgtgttcaaatggtggattctgaatttcagtatacttatgaatatcagggtaatgcttccaaactggtttatactccactgacagacaagtgctacttaactctcactcaagccatgaagatgggacttggaggaaatccttatggaccagctggaactgggaaaacggaatcagtaaaggctttaggtggacttcttggaagacaagttttagtctttaattgtgatgagggcatcgatgtgaagtcaatgggacgaatatttgttggtttggtgaagtgtggggcctggggttgttttgatgaatttaataggctggaagaatctgtactgtcagcagtttctatgcaaatccagacaattcaagatgctttgaagaatcatagaactgtatgtgaactgcttggcaaggaggtagaagtaaattctaattctggaatttttatcactatgaatcctgctggaaaaggttatggaggaagacaaaaactgcctgataatcttaaacagcttttcaggcccgtagctatgtctcatccagacaatgagcttattgcagaagttattctctattcggaaggctttaaagacgctaaagtattgagcagaaaattggtagctattttcaatctatctagggaacttttgacacctcagcaacattatgattggggtttgagagctttgaagacagttctgagaggaagtggaaatctccttagacagctaaacaaaagtggcactacacagaatgctaatgaaagtcatattgtggtacaagcactgaggcttaataccatgtcaaagtttacgtttactgattgcacccggtttgatgcactgataaaagatgtctttccgggaattgaattgaaagaagtggaatatgatgaactaagtgctgcattaaagcaggtctttgaagaggccaattatgaaattatacccaatcagatcaaaaaggctttagaattgtatgaacagttatgccagaggatgggagttgttattgttggtccaagtggtgctggaaaatcaacgctttggagaatgttaagggctgcgctttgtaaaactggcaaagtagtgaaacaatatactatgaatcccaaagctatgcctcgatatcaattattaggccatattgacatggacacaagagaatggtctgatggtgttttgacaaatagtgctcgtcaagtggttcgggaacctcaagatgtcagctcatggataatctgtgatggtgatattgaccctgaatggatagaatctctgaattctgttctggatgataatcgactgctgactatgcccagtggagaaaggattcagtttggcccaaatgttaactttgtatttgaaactcatgatttaagttgtgcatcaccagccacaatatctagaatgggaatgatctttcttagtgatgaagagacagatcttaattctctgataaaatcttggttgaggaatcagcctgctgaatatagaaataatcttgaaaattggattggagattattttgaaaaggctttacaatgggttctaaagcagaatgactatgtggtagaaacaagtttggttgggactgtgatgaatggtttgtcacatctacatggttgcagagatcatgacgaattcattattaatctcataaggggacttggtggaaatctgaatatgaagtcacgtttggaatttaccaaagaggtttttcattgggcacgagaatctcctccagactttcacaaacctatggatacctactatgactctactaggggtcgattagcaacatatgtgcttaagaagccagaagacttgactgctgatgatttcagtaacggcttaactcttccagtcattcagactcctgacatgcaacgaggtctagattatttcaaaccatggttaagttctgatactaaacagccctttattctggtaggaccagaaggatgtggcaaagggatgctgctcaggtacgcattttcacaactccggtccactcaaattgctacagttcactgtagtgcacaaaccacttctcgacatctcctgcagaaactgagccagacttgcatggtaatcagtactaatactggtcgtgtatacagaccaaaagactgtgaaagacttgttctgtacttaaaagatatcaacctacctaaacttgataaatgggggaccagtactttggtagcattcctacaacaggtattgacgtatcaaggattttatgatgaaaatttggaatgggttggtctagaaaatattcaaattgtggcttctatgtcagctggaggaagactgggaagacataaacttactaccagatttacttccatcgttcgtctttgttctatagattacccagaaagagagcagttacaaacgatttatggagcatatttggaaccagttctacataaaaatctgaagaatcattctatttggggttcttcatcaaaaatttatcttttagcaggatctatggtacaagtgtatgaacaggtgcgagccaaatttacagttgatgattatagtcactatttctttactccttgcattcttacccaatgggttcttggcttatttagatatgatttagaaggaggatcctcaaaccatccactagattatgtgttagaaattgtagcatatgaggcacggcgcttatttcgtgacaaaattgttggtgcaaaggaacttcatttatttgacatcattttaacatcagtgtttcaaggagattggggctcagacatattagacaatatgtcagatagtttctacgttacatggggagctcggcataattcaggagcaagggcagccccaggacaaccattacctccacatggaaaaccacttggaaaactaaactctactgatctcaaggatgttattaaaaagggtcttattcattatggacgagataaccagaatttagacattttacttttccacgaagtcttggagtatatgtctaggatagatagagtgctgagtttccctggaggttcacttctattagcaggacgcagtggtgtaggtcgtcggaccatcacttctttagtcagtcacatgcatggagcggtcctgttttctccaaagatttccagaggatatgaactgaagcagttcaaaaatgatctcaaacatgtgctgcaacttgcaggaattgaagcacaacaggtagttttacttcttgaggattaccagtttgtacatcctacatttttggagatgatcaatagccttttgtcttcaggtgaagttcctggactctatactcttgaagaattagagcccttgctgttaccacttaaggatcaagcttcacaagatggtttttttggaccagtcttcaattacttcacatatagaattcagcaaaacttgcatattgtcttgataatggattctgcaaattcaaacttcatgataaactgtgagagtaatccagctttgcataagaaatgccaggtgttgtggatggagggttggtccaatagcagtatgaagaaaatacctgaaatgttattcagtgaaacaggtggtggagaaaaatacaatgataaaaaacgaaaagaagaaaagaaaaaaaattcagttgatcctgattttctaaaatcatttttattaatccatgaatcttgtaaagcatatggtgctacaccaagccgatacatgacctttttacatgtgtattctgccattagtagtagcaagaaaaaggaattattaaaaagacaaagtcatttgcaggctggtgtatctaaactaaatgaagctaaagctcttgtggatgaactgaacagaaaagctggagaacaaagtgtgttacttaaaacgaagcaagatgaagcagatgctgcccttcaaatgatcacagtgtcaatgcaggatgctagtgagcaaaaaacagaacttgaaagactgaagcacagaatagcagaagaagttgttaaaattgaagaaagaaaaaataaaattgatgatgaattaaaagaagtacaacctttagtcaatgaagctaaactagcagttggaaacattaagcccgaatcactttcagaaattcgctcactacgcatgccacctgatgtaattagagatattcttgaaggagttttaaggttgatgggtatctttgatacatcttgggtgagcatgaaaagtttccttgcaaaaagaggtgtaagagaagacatagcaacctttgatgcccgaaatatttcaaaggaaataagagagagtgttgaagaacttctttttaaaaataaaggctcttttgatccaaagaatgctaagcgtgccagtactgcagctgcacctttggctgcctgggtgaaagccaatattcagtattcccatgtcttggaacgaattcatcctttggaaactgaacaggcaggattagaatcgaatctgaagaaaactgaagacagaaaaaggaaactagaggagcttcttaattctgttggtcaaaaggtatcagaactcaaagaaaaatttcagagcaggacttcagaagctgccaaacttgaggctgaagtaagcaaggcacaagaaacaatcaaagctgcagaagtcttaattaatcagcttgacagagaacataagagatggaatgcacaggttgtagagataacagaggaattagctactcttcctaaaagagctcaacttgctgctgcatttattacatatctttctgctgctcctgaatctctgagaaaaacctgtttggaagaatggaccaagtcagctggtcttgagaaatttgatctgaggagatttctttgtactgaaagtgagcagttaatttggaaaagtgaaggcctaccatcagatgacctttccatagaaaatgctcttgtaatattacagatcattggtttgaaatcatggagtcgagtgtgcccatttcttatagatccttcttcccaagctacagagtggttaaaaacacatttgaaagactcacgtttagaagttatcaatcagcaggatagtaactttatcacagctcttgaattagcagtacgttttgggaaaacccttattatacaagagatggatggtgtagaacctgttctttatccattattgagacgagatctggttgctcaaggaccacgttatgtggtacaaataggtgacaaaattattgactacaatgaagaattccgcctctttttgtcaacaagaaacccaaatccttttattccaccggatgcagcttccattgttactgaggttaactttactacaacaagaagtggattacgagggcagcttttagctttaaccattcagcatgagaaacctgatttagaagaacagaaaacaaaactattacaacaggaagaagataagaaaatacagctagccaagctcgaagaatctcttctagagacacttgccacatctcaaggcaatattttggaaaataaggatttgattgagtctttgaatcagacaaaagcaagcagtgcacttattcaagagtcacttaaagaatcttacaaactccaaatttcccttgatcaagaacgggatgcctatctccccctggctgagagtgccagcaagatgtacttcattatttctgatttgtccaaaattaataacatgtaccgttttagtttggctgcttttctccgacttttccaacgagctctacaaaacaaacaggattctgaaaatacagaacagagaatccagtcacttatcagctcattacaacatatggtatatgaatatatatgtcgttgtctatttaaggctgatcagttgatgttcgctttgcattttgttcgaggcatgcatcctgaactttttcaagaaaatgaatgggatacgtttacaggtgtggttgttggagacatgttacggaaagctgactctcaacaaaaaatacgtgatcagcttccgtcttggatagatcaggaacgaagctgggccgtggcaacattaaagattgctctccccagtctttatcagaccctctgctttgaagatgcagctctgtggcgtacttattataataattcaatgtgtgagcaagagtttccatctatccttgcaaagaaagtttccttatttcagcagattcttgtagtacaggcgctaagaccggacagattgcaaagtgccatggctctttttgcatgtaaaactctgggactgaaagaggtgtccccactgcctctaaatctcaaacgtttatacaaagagacactggaaattgaacccatcttgataattatttctccgggtgctgatccttctcaggaacttcaagaactagctaatgctgaaagaagcggagagtgttatcaccaggttgccatgggtcaaggtcaagctgatttagcaattcaaatgctaaaagaatgtgcccgcaatggagactggctctgtttgaagaacttacatcttgtggtatcttggctgccagttctggaaaaggaattgaatactcttcaacctaaagatacctttcgtctttggctcactgcagaagttcatcccaactttactcctattttactacagtcaagtctgaagataacatatgagtcacctccaggtttaaagaagaatttaatgcgtacttatgagtcttggactcctgagcaaattagcaaaaaagataatacacatcgagctcatgctctcttcagtcttgcatggtttcatgctgcatgtcaagaaagaagaaactatattcctcagggttggacaaagttttatgaattttctttatcagatcttcgggctgggtacaacattattgacagactttttgatggtgccaaagatgtacaatgggaatttgtacatggtttacttgaaaatgctatttatggaggacgtatagacaactattttgaccttagagttcttcagtcatacctgaagcagttttttaattcttcagttattgatgtattcaaccaaaggaacaagaaaagcatttttccatattccgtatctctaccacaatcctgcagcattttggactatcgtgctgtcattgagaaaattccagaggacgacaaacctagtttctttggtctgcctgccaatatcgctcgctcatctcagcgcatgatcagttctcaggttatttcacagttgaggattttgggcagatccataacagctggttccaaatttgatagagaaatctggtctaatgaactttctcctgtcctcaatctctggaagaaactaaaccagaattcaaacctaatacatcagaaagtgcctcctcctaacgatcgacaaggatctccaatactgtcattcatcattcttgaacaatttaatgctattcgtttagtacaaagtgtccaccagtctcttgctgctctcagcaaagtcatcagaggaactactttactgagttcagaagtacaaaaattggcaagtgctttattaaaccaaaagtgtcctctcgcatggcagagcaagtgggaaggcccagaagatcccttacaatacctgagaggtcttgttgcccgtgcccttgcaatacagaactgggtagataaagctgaaaaacaggctcttctctctgaaacacttgacctatcagaacttttccatccagacacatttcttaatgctcttcgccaggaaactgcaagggcagtgggtcgttctgtggatagccttaaatttgtagcctcatggaaaggtcgactgcaagaagcaaagctacaaattaagatcagtggcttgttactagaaggatgtagttttgatggaaatcaactttctgaaaatcagcttgattctcccagcgtgtcatcagtgctcccttgttttatgggctggattccacaggatgcatgtggtccatattctccggatgagtgcatctctttgcctgtttacacaagtgctgaaagggatcgtgtggttaccaatattgatgttccatgtgggggcaaccaagaccagtggattcagtgtggagcagctctattcctaaaaaatcagtag

SEQ ID NO: 128625 - DNA, 2479 bp, Homo sapiens
  Payload ID: 5173
  Gene Symbol: DYNC2H1
  Gene Name: dynein, cytoplasmic 2, heavy chain 1
  ENST ID: ENST00000528670
  CDS Start-End: 1-1137
caaaaaatacgtgatcagcttccgtcttggatagatcaggaacgaagctgggccgtggcaacattaaagattgctctccccagtctttatcagaccctctgctttgaagatgcagctctgtggcgtacttattataataattcaatgtgtgagcaagagtttccatctatccttgcaaagaaagtttccttatttcagcagattcttgtagtacaggcgctaagaccggacagattgcaaagtgccatggctctttttgcatgtaaaactctgggactgaaagaggtgtccccactgcctctaaatctcaaacgtttatacaaagagacactggaaattgaacccatcttgataattatttctccgggtgctgatccttctcaggaacttcaagaactagctaatgctgaaagaagcggagagtgttatcaccaggttgccatgggtcaaggtcaagctgatttagcaattcaaatgctaaaagaatgtgcccgcaatggagactggctctgtttgaagaacttacatcttgtggtatcttggctgccagttctggaaaaggaattgaatactcttcaacctaaagatacctttcgtctttggctcactgcagaagttcatcccaactttactcctattttactacagtcaagtctgaagataacatatgagtcacctccaggtttaaagaagaatttaatgcgtacttatgagtcttggactcctgagcaaattagcaaaaaagataatacacatcgagctcatgctctcttcagtcttgcatggtttcatgctgcatgtcaagaaagaagaaactatattcctcagggttggacaaagttttatgaattttctttatcagatcttcgggctgggtacaacattattgacagactttttgatggtgccaaagatgtacaatgggaatttgtacatggtttacttgaaaatgctatttatggaggacgtatagacaactattttgaccttagagttcttcagtcatacctgaagcagttttttaattcttcagttattgatgtattcaaccaaaggaacaagaaaagcatttttccatattccgtatctctaccacaatcctgcagcattttggtaggactatcgtgctgtcattgagaaaattccagaggacgacaaacctagtttctttggtctgcctgccaatatcgctcgctcatctcagcgcatgatcagttctcaggttatttcacagttgaggattttgggcagatccataacagctggttccaaatttgatagagaaatctggtctaatgaactttctcctgtcctcaatctctggaagaaactaaaccagaattcaaacctaatacatcagaaagtgcctcctcctaacgatcgacaaggatctccaatactgtcattcatcattcttgaacaatttaatgctattcgtttagtacaaagtgtccaccagtctcttgctgctctcagcaaagtcatcagaggaactactttactgagttcagaagtacaaaaattggcaagtgctttattaaaccaaaagtgtcctctcgcatggcagagcaagtgggaaggcccagaagatcccttacaatacctgagaggtcttgttgcccgtgcccttgcaatacagaactgggtagataaagctgaaaaacaggctcttctctctgaaacacttgacctatcagaacttttccatccagacacatttcttaatgctcttcgccaggaaactgcaagggcagtgggtcgttctgtggatagccttaaatttgtagcctcatggaaaggtcgactgcaagaagcaaagctacaaattaagatcagtggcttgttactagaaggatgtagttttgatggaaatcaactttctgaaaatcagcttgattctcccagcgtgtcatcagtgctcccttgttttatgggctggattccacaggatgcatgtggtccatattctccggatgagtgcatctctttgcctgtttacacaagtgctgaaagggatcgtgtggttaccaatattgatgttccatgtgggggcaaccaagaccagtggattcagtgtggagcagctctattcctaaaaaatcagtagaatctaatgacaacaaaagccatcttcacaaaagggaacattgattctttaagctttaaatcaaacatgtggtcagtctacatttgaaatgttagttcaaaatattaacatatagttatgttgttgatgtcactgaaattttaatgtgtaaaagcagcactgtgcatcttttaaagtaataaattaatggagttattgttaaaacagagtattcttttgacaacattaaatatttctgtgagaaagttcacttttccagtggctcaaaaatttgttttaggtcagagattttaagtggtatattaaccaataataaatattttggctgtcatttgtgtcataattatttaataaaagagcattcataatttt

SEQ ID NO: 128626 - DNA, 767 bp, Homo sapiens
  Payload ID: 5173
  Gene Symbol: DYNC2H1
  Gene Name: dynein, cytoplasmic 2, heavy chain 1
  ENST ID: ENST00000533197
  CDS Start-End: 1-675
gttatttcacagttgaggattttgggcagatccataacagctggttccaaatttgatagagaaatctggtctaatgaactttctcctgtcctcaatctctggaagaaactaaaccagtgtcctctcgcatggcagagcaagtgggaaggcccagaagatcccttacaatacctgagaggtcttgttgcccgtgcccttgcaatacagaactgggtagataaagctgaaaaacaggctcttctctctgaaacacttgacctatcagaacttttccatccagacacatttcttaatgctcttcgccaggaaactgcaagggcagtgggtcgttctgtggatagccttaaatttgtagcctcatggaaaggtcgactgcaagaagcaaagctacaaattaagatcagtggcttgttactagaaggatgtagttttgatggaaatcaactttctgaaaatcagcttgattctcccagcgtgtcatcagtgctcccttgttttatgggctggattccacaggatgcatgtggtccatattctccggatgagtgcatctctttgcctgtttacacaagtgctgaaagggatcgtgtggttaccaatattgatgttccatgtgggggcaaccaagaccagtggattcagtgtggagcagctctattcctaaaaaatcagtagaatctaatgacaacaaaagccatcttcacaaaagggaacattgattctttaagctttaaatcaaacatgtggtcagtctacatttgaaatgt

SEQ ID NO: 128627 - DNA, 1399 bp, Homo sapiens
  Payload ID: 5174
  Gene Symbol: DYNC2LI1
  Gene Name: dynein, cytoplasmic 2, light intermediate chain 1
  Uniprot ID: Q8TCX1
  ENST ID: ENST00000260605
  CDS Start-End: 101-1156
agaaggcctcactcccagactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgatcatgaattaattgacccatttccggtacctctggtcataattggaagtaaatatgatgtttttcaggattttgagtctgagaagagaaaggtaatatgcaagacacttcgatttgttgcacattattatggagcatcattaatgtttaccagtaaatcagaagctctattactaaaaatacgtggagttatcaaccagttggcatttggcattgacaaaagcaaatcaatatgtgtggatcagaataaaccgctgtttatcacagcaggattggattctttcggtcaaataggatctcctcctgttcctgaaaatgacattggaaagcttcatgcccactcacctatggagttgtggaaaaaagtgtatgaaaagctctttccaccaaagagtattaacacgctgaaagatatcaaggaccctgcgagagatcctcagtatgctgaaaatgaagtcgatgagatgagaattcagaaggatctggaactggaacagtacaaaagaagttcttccaagtcttggaaacaaatcgagcttgattcttgaacctatttcaattattgtatatttatttcttcttttccaaatacaaataagattatactgtgaattaactattgtggcaatatgtgaagaaagttaaactgtataatttgttaaaggacaagctggatttcttggactagtgcatctccctgtatatcttgaagctttttaaaaggaaaaattattgtagaaccacgtgtaattttttttaaaataaaagaatcttctactacctacctctaa

SEQ ID NO: 128628 - DNA, 1253 bp, Homo sapiens
  Payload ID: 5174
  Gene Symbol: DYNC2LI1
  Gene Name: dynein, cytoplasmic 2, light intermediate chain 1
  ENST ID: ENST00000378587
  CDS Start-End: 1-956
ggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgatcatgaattaattgacccatttccggtacctctggtcataattggaagtaaatatgatgtttttcaggattttgagtctgagaagagaaaggtaatatgcaagacacttcgatttgttgcacattattatggagcatcattaatgtttaccagtaaatcagaagctctattactaaaaatacgtggagttatcaaccagttggcatttggcattgacaaaagcaaatcaatatgtgtggatcagaataaaccgctgtttatcacagcaggattggattctttcggtcaaataggatctcctcctgttcctgaaaatgacattggaaagcttcatgcccactcacctatggagttgtggaaaaaagtgtatgaaaagctctttccaccaaagagtattaacacgctgaaagatatcaaggaccctgcgagagatcctcagtatgctgaaaatgaagtcgatgagatgagaattcagaaggatctggtattatcctaaacatttacttaatttcatctgaaattttaacacaaaacctggggtgccttgggaattccttacatttttctctatgtatttacttagagtatcttctttactattaaaattatttaagtagtacatctatttaaataacacactaatagtatactgtagaaaaaataaaaatttgatatgaataaagaaaaatttttaaatcacctgtcatcccaccacccagacatgacttagtgttcacataaacctttttgattttccagttttcattatattaaagatgagtggtgattctta

SEQ ID NO: 128629 - DNA, 2903 bp, Homo sapiens
  Payload ID: 5174
  Gene Symbol: DYNC2LI1
  Gene Name: dynein, cytoplasmic 2, light intermediate chain 1
  Uniprot ID: Q8TCX1
  ENST ID: ENST00000398823
  CDS Start-End: 76-510
gcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacgctcctggcaactatcatccctactgcctgtctctatgaatttgaccactccagtacctcatataaatgaaatcattcattatttgtccttttgttatttatttcatttagcataacgtcttcagggttcttccgtttgtagtatgtgtcaggatttccctcacttctaaggctaaataatgttccattgtgtaaacaaataccacagttcagttatccgttaatccatgcagaacatttgggttgttttcatcttttgactattgtgagtaatgctggtatgaacattggtgtacattatctgtttaaatctcttccttcagttcttttgggtttagactcagaagtggaattgctggatcatctggtaattctatggtgaattttttgaggaatcactatactattttacacagtggctgcaccattttacattcccataagcaatgtacaggggttctaatttctctgtatcctcactaatacttgttatcttctcatttaaaaaaatgttttaggccaggagtggtggcttacacctgtaatcccaacactttgggaggctgaggtgggtagatcacctgaggtcaggagttcgagaccagcctgggcaacatggtgaaacctcgtctctactaaaaatacaaaaattagccggatgtggtggtgcatgcctgtgatcccagctacttgggaggctgaggcaggagaatggcttgaacccgggaggcagaggttgcagtgagctgagatcatgccactgtactccagcctggacaatagagactcctcctccaaaaacaacaacaaaaaaatgttttgacaatagctagcctaatggataggaagttggacatcttttcatgtgttaattggccatctgtatatcttctttggcgaaatgtctatttgagtcttttgccttctttttttttttttttaatatagttgagttggggtctcactatgttgcccaggctggtcttgaactcctggcctcaagtgatcctcctgcctcagcttcccaaagctctagaattacagacatgagccaccatccctggcctctttgcccatttttgaacaggaatgtttgtttttgttgccgagtctaggtttatgtttgatgggcatgaacagaatacaagtgcatgtggtgatggtggtcatgtatctggtggtcaggagtgtgctttcagagagacagaatggtattgcagaaaaacgtgtaactttggatctaaataccagttctacaatttactaattatataaatctgtgcctcagacttctaatctataaaatggacattataacatcttctggagagggttattgtggagattaactaggtagttccctagcaaggtccacccatatatctattttcttctcctttacctgattattgtgttactgtttttgcttcttttattatttttgcttcccttttttggagcacacagtaaaactggatgtaaacgtggcattgtcgatgcaaatgcttggagcttctctatttgaactaaactacttttaattttagttcaaacagaaacttagttccactattgtaacacttaaatattactagaggaaagtattggaataaataaggctatgactttggttttttgtttttgggagtcttagaataatgctacggtttttttttccccttaaggtatattttagttattcttagataaatttcagtacattaggatttcaaaatggtaattattttgagtcttttttgaaaagtgtttttatttctttaggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgtgagttgctgtttgggattattactggaatccttagtcccatttatagttaatgataacatcacaaacaacttctttagatttttatgcatgacttgaaattcatttgatgtagatgaacctgttcactggaaaattacagcaatttattaaaacctcagtaagagcaaaacaaggaagaagattccttatatcttcttgttagacatcttctgtgattgttatggcatattacaccaatcagagaaatagagttttaaagtagtggtttgatattgattttataatctctgtaaaaatgaagataaaaagccagattgtacaaaagtcacctgacaaagactagatgaagctacaactttaagcaaggggtagagttgtaatagccttcaccatcactctgtattttacattcatttcgtttctgtcacttattcagtatctttttatcatctgacagctaattaaattataaagttgctatgatggtaacacaagttcttcaaatacaataataaatatcatcatctggaaaactga

SEQ ID NO: 128630 - DNA, 1133 bp, Homo sapiens
  Payload ID: 5174
  Gene Symbol: DYNC2LI1
  Gene Name: dynein, cytoplasmic 2, light intermediate chain 1
  Uniprot ID: Q8TCX1
  ENST ID: ENST00000406852
  CDS Start-End: 91-696
actcccagactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgtgagttgctgtttgggattattactggaatccttagtcccatttatagttaatgataacatcacaaacaacttctttagatttttatgcatgacttgaaattcatttgatgtagatgaacctgttcactggaaaattacagcaatttattaaaacctcagtaagagcaaaacaaggaagaagattccttatatcttcttgttagacatcttctgtgattgttatggcatattacaccaatcagagaaatagagttttaaagtagtggtttgatattgattttataatctctgtaaaaatgaagataaaaagccagattgtacaaaagtcacctgacaaagactagatgaagctacaactttaagcaaggggtagagttgtaatagccttcaccatcactctgtattttacattcatttcgtttctgtcacttattcagtatctttttatcatctgacagctaattaaattataaagttgctatgatggtaacacaagttcttcaaatacaataataaatatcatcatctggaaaa

SEQ ID NO: 128631 - DNA, 713 bp, Homo sapiens
  Payload ID: 5174
  Gene Symbol: DYNC2LI1
  Gene Name: dynein, cytoplasmic 2, light intermediate chain 1
  ENST ID: ENST00000462426
  CDS Start-End: 54-281
aggctggtcactactccgagcctgtgacgtttgcggcagccaggccgtcgacgatgcccagacagagtctcgctctgttgcccaggctggagtgcagtggcacgatcttggctcaatacaacatccacctcctgagttcagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctcaggatcatgaattaattgacccatttccggtacctctggtcataattggaagtaaatatgatgtttttcagg

SEQ ID NO: 128632 - DNA, 547 bp, Homo sapiens
  Payload ID: 5174
  Gene Symbol: DYNC2LI1
  Gene Name: dynein, cytoplasmic 2, light intermediate chain 1
  ENST ID: ENST00000496980
  CDS Start-End: 91-375
actcccagactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggagtctcgctctgtcgcctaggttcgagtgcagtggtgtgatctcggctcactgcagcctctgcctcctgggttcacaccattctcctgcctcagcctcccaagttgctgggactgcaggtgcccacgaccacgcctgggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacg

SEQ ID NO: 128633 - DNA, 568 bp, Homo sapiens
  Payload ID: 5174
  Gene Symbol: DYNC2LI1
  Gene Name: dynein, cytoplasmic 2, light intermediate chain 1
  ENST ID: ENST00000479242
  CDS Start-End: 91-309
actcccagactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgatcatgaattaattgacccatttccggtacctctggtcat

SEQ ID NO: 128634 - DNA, 1346 bp, Homo sapiens
  Payload ID: 5174
  Gene Symbol: DYNC2LI1
  Gene Name: dynein, cytoplasmic 2, light intermediate chain 1
  Uniprot ID: Q8TCX1
  ENST ID: ENST00000605786
  CDS Start-End: 58-1116
ttctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctcaggatcatgaattaattgacccatttccggtacctctggtcataattggaagtaaatatgatgtttttcaggattttgagtctgagaagagaaaggtaatatgcaagacacttcgatttgttgcacattattatggagcatcattaatgtttaccagtaaatcagaagctctattactaaaaatacgtggagttatcaaccagttggcatttggcattgacaaaagcaaatcaatatgtgtggatcagaataaaccgctgtttatcacagcaggattggattctttcggtcaaataggatctcctcctgttcctgaaaatgacattggaaagcttcatgcccactcacctatggagttgtggaaaaaagtgtatgaaaagctctttccaccaaagagtattaacacgctgaaagatatcaaggaccctgcgagagatcctcagtatgctgaaaatgaagtcgatgagatgagaattcagaaggatctggaactggaacagtacaaaagaagttcttccaagtcttggaaacaaatcgagcttgattcttgaacctatttcaattattgtatatttatttcttcttttccaaatacaaataagattatactgtgaattaactattgtggcaatatgtgaagaaagttaaactgtataatttgttaaaggacaagctggatttcttggactagtgcatctccctgtatatcttgaagctttttaaaaggaaaaattattgtagaaccacgtgtaattttttttaaaataaaagaatcttctac

SEQ ID NO: 128635 - DNA, 720 bp, Homo sapiens
  Payload ID: 5175
  Gene Symbol: DYNLL1
  Gene Name: dynein, light chain, LC8-type 1
  Uniprot ID: P63167
  ENST ID: ENST00000242577
  CDS Start-End: 168-437
ggcgggagcagggcggggcctgagcactaggcggcggcggctggcgtggggctgcttagatgcgccacggtttcggtagcgacggtatctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 128636 - DNA, 697 bp, Homo sapiens
  Payload ID: 5175
  Gene Symbol: DYNLL1
  Gene Name: dynein, light chain, LC8-type 1
  Uniprot ID: P63167
  ENST ID: ENST00000392508
  CDS Start-End: 147-416
ggcggctggcgtggggctgcttagatgcgccacggtttcggtagcgacggtatctctagccgggcctgagctgtgctagcacctcccccaggagaccgttgcagtcggccagcccccttctccacggccttgcccactaggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatg

SEQ ID NO: 128637 - DNA, 814 bp, Homo sapiens
  Payload ID: 5175
  Gene Symbol: DYNLL1
  Gene Name: dynein, light chain, LC8-type 1
  Uniprot ID: P63167
  ENST ID: ENST00000392509
  CDS Start-End: 262-531
gctgacagggagagcctggggccgggccgtgtggatgccatccccgagcgcggttcgcgctcggctgaggcgctggacaagtggcttgggctcccgcgcctcagtttctctctgtggcgccgcctacctcacagacttgtgagcactcactgacgtgggtagcgcccagggcctgcggggcgcaggagagctggagtcaggcggagaccgcaggctgaccccgcagcggccgggctgtcgcggcccccacctcaggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 128638 - DNA, 581 bp, Homo sapiens
  Payload ID: 5175
  Gene Symbol: DYNLL1
  Gene Name: dynein, light chain, LC8-type 1
  ENST ID: ENST00000550178
  CDS Start-End: 322-525
gtggggctgcttagatgcgccacggtttcggtagcgacggtatctctagccgggcctgagctgtgctagcacctcccccaggagaccgttgcagtcggccagcccccttctccacggtgagaaactcggggggccagggggtgtcctcgctgccttatttcgccccactccggacttagccctccgcgtagcccgcgcttcctgagaagtggggtggggggcgtcgtcccgtggtggcgccggccggggtgggggcagttagtgcctggggggcgcggcccaactcaaccccttaccccaggccttgcccactaggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggtgaggatgggcgcgggggccgatacgcagccgggagcagggggttccttccccccgatcctgctttcctaagggcgcctgacaggtcccgggaatactgctggcggcttggggcgtagaagcttcca

SEQ ID NO: 128639 - DNA, 719 bp, Homo sapiens
  Payload ID: 5175
  Gene Symbol: DYNLL1
  Gene Name: dynein, light chain, LC8-type 1
  Uniprot ID: P63167
  ENST ID: ENST00000549989
  CDS Start-End: 310-579
agatgcgccacggtttcggtagcgacggtatctctagccgggcctgagctgtgctagcacctcccccaggagaccgttgcagtcggccagcccccttctccacggtgagaaactcggggggccagggggtgtcctcgctgccttatttcgccccactccggacttagccctccgcgtagcccgcgcttcctgagaagtggggtggggggcgtcgtcccgtggtggcgccggccggggtgggggcagttagtgcctggggggcgcggcccaactcaaccccttaccccaggccttgcccactaggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagg

SEQ ID NO: 128640 - DNA, 1376 bp, Homo sapiens
  Payload ID: 5175
  Gene Symbol: DYNLL1
  Gene Name: dynein, light chain, LC8-type 1
  ENST ID: ENST00000550845
  CDS Start-End: 125-328
agatgcgccacggtttcggtagcgacggtatctctagccgggcctgagctgtgctagcacctcccccaggagaccgttgcagtcggccagcccccttctccacggccttgcccactaggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggtgaggatgggcgcgggggccgatacgcagccgggagcagggggttccttccccccgatcctgctttcctaagggcgcctgacaggtcccgggaatactgctggcggcttggggcgtagaagcttccagaaaggacgcagatgcattttgcgctcctgtggagaagaccagacccccggcgtccgaagtttttttttttttttttttaattacccagctccgcggggggaaagcgccacctagcaacggtatctaagatcagggagcagcggttcccccttctgtgtggttcctgcgccgaggatccatctgggtgttccggaggggggagctgcgtgggtgtttccagccgggccgggaggagatcttgccagccttccagtggggagttgagggaaggtggtgggtggtggcggggctgggggctggggtaggggcttggtaaatggcagtctagaaagccggcaggactgccaacttctcgagcagtgtttgctggaagggaagaaagctggcagcctaagccgtgggagggttccagtcgagaatgggaagatgaaagacttcagatggaacagaaataaatgccttttttgacaaacgcagcagtgcgtgcctctagcttgcaagagcgttactccccttcatagctttaaaaggttttcgcactgcgtgcagttagagtagctaaatcttgtgtgacgctccacaaacacttgtaagaattttgcagagaaagataaccgttgccacccaatgccccccacaggcattctactccccagtacctcttagggtgggagaaatggtgaagagttgttcctacaacttgctaacctagtggacagggtagtagattagcatcatccggatagatgtgaagaggacggctgtttggataataattaaggataaaatttggccagttgacagattctgtttccagcagtttttacagcaacagtggagtgcttcagtattgtgttcctgtaaatttaattttgatccgcaatcatttggtatacaatgctgtttgaagttttgtcctattggaaaagtcttgtgttgcaggggtgcagttaagatctttgtgatgaggaatgggatgggctaatttttt

SEQ ID NO: 128641 - DNA, 662 bp, Homo sapiens
  Payload ID: 5175
  Gene Symbol: DYNLL1
  Gene Name: dynein, light chain, LC8-type 1
  Uniprot ID: P63167
  ENST ID: ENST00000548342
  CDS Start-End: 366-635
gatgccatccccgagcgcggttcgcgctcggctgaggcgctggacaagtggcttgggctcccgcgcctcagtttctctctgtggcgccgcctacctcacagacttgtgagcactcactgacgtgggtagcgcccagggcctgcggggcgcaggagagctggagtcaggcggagaccgcaggctgaccccgcagcggccgggctgtcgcggcccccacctcagagccactggtggccgcagaagacagtccacgtgtcttaaccagacttacaagactccaaagatgggtgccttgtatcaagcaggtgctcaacaaatgtctgctgaaaaaatgatgcagggtgcggtggttcacgcaggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagt

SEQ ID NO: 128642 - DNA, 616 bp, Homo sapiens
  Payload ID: 5175
  Gene Symbol: DYNLL1
  Gene Name: dynein, light chain, LC8-type 1
  ENST ID: ENST00000548214
  CDS Start-End: 142-345
ctaggcggcggcggctggcgtggggctgcttagatgcgccacggtttcggtagcgacggtatctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggtgaggatgggcgcgggggccgatacgcagccgggagcagggggttccttccccccgatcctgctttcctaagggcgcctgacaggtcccgggaatactgctggcggcttggggcgtagaagcttccagaaaggacgcagatgcattttgcgctcctgtggagaagaccagacccccggcgtccgaagtttttttttttttttttttaattacccagctccgcggggggaaagcgccacctagcaacggtatctaagatcagggagcagcggttcccccttctgtgtggttcctgcgccgaggatccatctgggtgttccggaggggggagctgcgtgggtgt

SEQ ID NO: 128643 - DNA, 794 bp, Homo sapiens
  Payload ID: 5175
  Gene Symbol: DYNLL1
  Gene Name: dynein, light chain, LC8-type 1
  ENST ID: ENST00000549649
  CDS Start-End: 669-794
gggagagcctggggccgggccgtgtggatgccatccccgagcgcggttcgcgctcggctgaggcgctggacaagtggcttgggctcccgcgcctcagtttctctctgtggcgccgcctacctcacagacttgtgagcactcactgacgtgggtagcgcccagggcctgcggggcgcaggagagctggagtcaggcggagaccgcaggctgaccccgcagcggccgggctgtcgcggcccccacctcagagccactggtggccgcagaagacagtccacgtgtcttaaccagacttacaagactccaaagatgggtgccttgtatcaagcaggtgctcaacaaatgtctgctgaaaaaatgatgcagggtgcggtggttcacgcagtaaagatggggtttcaccatgttagccaggatggtcttgatctcctgacctcgtgatccgcctgcctcggcctcccaaagtgctgggattacaggcgtgagccaccacacccggccatataaggaaagactgcctcacctgagcaagaagcttcaccctggacaaaaaccccggggctcaacactcccaaatccacccggatccccatccccaaccccttaaaggatgtccgcattgcttggcagagaccccactcttggggataatcccttaattcgtaaccatgtgcgaccgaaaggccgtgatcaaaaatgcggacatgtcggaagagatgcaacaggactcggtggagtgcgctactcaggcgctggagaaatacaacatagagaaggacattgcggctcatatc

SEQ ID NO: 128644 - DNA, 595 bp, Homo sapiens
  Payload ID: 5175
  Gene Symbol: DYNLL1
  Gene Name: dynein, light chain, LC8-type 1
  ENST ID: ENST00000552870
  CDS Start-End: 111-254
agatgcgccacggtttcggtagcgacggtatctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaa

SEQ ID NO: 128645 - DNA, 6805 bp, Homo sapiens
  Payload ID: 5176
  Gene Symbol: DYNLL2
  Gene Name: dynein, light chain, LC8-type 2
  Uniprot ID: Q96FJ2
  ENST ID: ENST00000579991
  CDS Start-End: 279-548
gctcagcggcagagcggagcggagctgtgaggcgccagtgcggagcgggcgggcgggcgggcggcgtgaggcggagcgcgggcggccggcgaaactccaagggcggaccgcggcagggagcgatcggcctcgggctgcgggagccggagaccgcggcggcggcggctgctgcagctgcaggaggagcccagggaacaccgcccctgcctgtgctctgcctcgggccatcgctcctccccagggcccagtgcggactcgcctccgtgaagtgtcacaccatgtctgaccggaaggcagtgatcaagaacgcagacatgtctgaggacatgcaacaggatgccgttgactgcgccacgcaggccatggagaagtacaatatagagaaggacattgctgcctatatcaagaaggaatttgacaagaaatataaccctacctggcattgtatcgtgggccgaaattttggcagctacgtcacacacgagacaaagcacttcatctatttttacttgggtcaagttgcaatcctcctcttcaagtcaggctaggtggccatggtgaaggtgtcagtggcggcggcagcgatggcaagcaggcggcgttgctgggactgttttgcactggagccagcatcaggatgtcctctccaatggctgtgctactgcatggactgtatactcgatttcatgtgtatgtcgcagtaaacaaaaccaaacctctttctgtttagttgcctgggggaagaaggctgctttatgtttatttttcaagactttaaaaatattttttggttgtattgcactaggaaatctctcccacctctcccttttctctttctttccctatacaaaataaaaggcccaccatagagactaggcggccgaaagactaggagggctgaggaaaagaaataggtctctggaggtggaactaaaactgtgcagctgcctcttcctggcggtggatgctgctttgggagggccagggaggctgcagggggacagtgttgggattgtcaaggaaaaaggggtaggaaggaaggtggagggattgatctagtaccagggagaatattccactgaactgtgattctatggcttggggcggagggtggggtggggatgccttctttaggggccctgagatgtgtttgtctgtggtgtgtgggagtggggagcagatttgtcttgctgtctttgtcagaatttctaagtaagggctgtgtctttgtggattaccttcttttgttcttcctgccagagatcatgacaggaggatgctggggtaggattagcttgaatcttttttttctttacatttttctcctgtctgctccctgcttagccctcagtttcctcattcctctggagttctcttagagcagcccctgttgttagttggctggcaagggaatttctggtgactgtagttccttagttaggtcttagcaatcaaaccaaattgatgtctcccttgactcttctgtgtatatgtgtgaatatgtgtgtatatgtgtgtgtatgtgtgtgtggggtttggggtagaagggagggagggggcaggacagtgtggaatctctagggtgtatgggtaggtagggggcacagttagttctaagtgggcttttatgctaaaagcctctggggatatctgttttgaaaataaagataggtgtcccctccttgctgtcatctagcccagacactctgcttgctctctggctgtctgctccctgggaaggctttaggaggaccacccaggacaggatgaccatgctgccatctgctctggagctgggtctcagtgcagagggacagtgactgtggatggttgcagtctctggtgggaggtgaggatagaagtgataaagagctaagaggagcttctgggagccttggaggaggtcagtcttgcagtggtgaagccaggacataggagatggagcagggctgtgagaggaggagattctgaggaggatgcaggggaaatcttgtctgttaatgaaataggagtggggtggggtttggggtggggtggtcattgccgtttgagctgctgattttcatgagtcgccttcaaaactctcgtgtagggttgacaatgtgggggggtgggggatccagcttattcttttattttcaagtccattcttggggctggtggggaggcaggagaatacccctccctaagcccttagtgtgtgccgagcttgctttgtgatgttggcaggggaggggagacctgggtggtgactgagttccctttatcaaacccttcagtgggcacaaaattgagtgcttgattttaggttttatttttttatgaatgtccaaatctgtgtttccccctgccctcccagactgtgtggccagttgaaagtgtctggtttgtgttcatctctccctcatttctggagcagggcctgagaccctgccacatctcctatgctctgcatccacgcctcttttggacattaaaggttgattgatgcacctctgcactgtttgggtctctttggggatgaggggttggcatggtggcagtggtgccacacagtgggtgagggtggagagtctccagggtggaatagaatggggactgaagggaagaccagccactagatactgattggcctgtagcagcacttatttgtgcctaggcttatgccccttaagtagaggaaaactaaccagcagcactcacccttaagggctcctgggttctgccttccttggtggtgatggccaggtgaatcatattttgtgtctttgggatagtaactgctaccttcccagctgccgtcatggacctgcctgagctttgctgcttcaacttttgcccaaagctcttatctttcatactcctcccttctcggctttcctgaacctggagactatttagcaaagggtctggccactcagaaatggaaagctggggatatttagaaagatggcacctcttttggtggaacctaagtgattctctgaatcctctgttgcccagacacacaactcgagaaatcagcagtgccaagacttctgagagtgtctgcccacccctgactccaccatcgtgtgactgcaattctcttggaggtgttagggagccagaggtgctttgccctctttgtgttactatttctttactcaaaaatatttaagagttcttgtatgcttgggcctaggatgctgttcacagaggagaatgagacaagtaagttctaggcttctatgacatacacattcttatgtgtagagcagacatacacacactgatcaactttttccaatagtgataaatgtgttatcaaggaaatgaactgggcaatgagctattgagtgttggaggtaggtagatagggttcctccagttaggaaggtggttggctgatcttggggagaagttctacctctggggcagtgaggtcctaagggattaagttgagagactctagagccccaacttctgttactgctttagctgtcgtgagtaatttgacagagctggagctttgggagggagagtgaggccacagttcacatttcatcagggatgagtgtctccagggccaaagctcatctactttcttccctgatgaaagaggcagtccaggtggcatctgtgaacaacacattcctgcacaggtaggtgcacagtgctcatctggaagactaatcctgcagggcttcctggaggagatgagcctccacttttcggggcccaggatgggaaagtatgtgagcatgtgtcactgaagggactgtggaaagcagatggaaattgtggaattctctcggaacaatgcagccattattagaactgtgcccataggagcatcaatatccctgctccttgtatcctgttctccagtcttctggggaccccctttgactgaacccaaccaaatggcagatgacaaggcagacccaggatgcagtctgtagggttcagtccccctccccactgggaacagcaggaaagggcaaggtggtgacaatctaagggaggcaaatggataataaccagcatggtagggaatcttctttgttgctgtggcactgtcgatctctgttccctgaactctagtgtcctccagactagatttaaggtgtggttccccgctaaattattctctcacctcctttcagtctttgctcaaacatccttttatcagagaggctttctgacatcctgtgcaagatagcacctctcccccatcgctgttatccttacccagtttaattccacgtagcatctgccaacgcttgacatatttgttttttgtttactttctggcctgtgacaactagaatataagctctgtgagagcatttttctcttaactgcttatcttcaagtaaacagaacagtgcctgtcctgtaggaagtgtttgatacatacagattgctcaaatgaaaaaagaagggtgcgagcaagcctggacaggcctggtgccccagggcagccttgccttttctgaagagaatggctgccttaggcacggctctccttgctgcccaagccttgccaccttgaaaggcgtgagagggtcactcccaggtgtattcaagcaagagtgcctgagccactcttgcttggcagtatgggaggatgaaatagtgtgttcataaagtgcattttatttttaaagcatttcagtttatgttgctgaaacctgagagcgcccccctgagctagactcagtaatcattagacacatttttggataagcaaactgaatcagagaaggtgagtggcaaagcccatgtagctggtggcattactagaacttagcactgtgatgcacaaaggcttaactgggtttggcagcaagggtctcatggatactctttaagatgtaggcccagatctcttagtagtgaatccctgatgttccctctcttggggctctggtttagcaaggacagcgaggatactttcctctctccctcctccttactcctctctactaaggattaaggagccacctcttcctccttaaggcctttgggagagatgggtctcctggtattagaaaggagagcagacgcctagagttctgacctcttgggcctcccctaaacaaaaagcatagccccttcactaccctagtaacaagtatgacctgttgcctgttgaggtcaggtgtacctgtgtgtctctctctgtgatgtatgtgggcttggtgtccacatcaatgtgcgtgaatactcctacccacagactgctactgtgccaatatagaggttcataagaaagataaaagagaaccagcagaaccccaggttctgcctctccttcctccctttgcccagataaaggtgtacagtgtttgtggtgaggctgctggacactgctgttttgggctttctagagagaatgcaaacatgcaaaaacagtgtggtagtgtaggcagaacaagatctagaatcagaagacctggagtcgaatctcagctccaacacccactggatgaacgtggacaagctgcttgatctctcagatcctcgatttcttcatctgtaagatggaaacaatatgtgtcttttctaaggggaaagatcaaatgacatcatgtatgtgaaaatgcttagaaatgggtgatgatgatgatgatgatactgattattagggtatctaataaagttggggaaagaacaaaatccccccctcacaccctattgcaccaccagccttctccctccctgctcaattatacccatgttatagggaaggaaatagggaagaaacttgtctaaggtcacatggatgttcgcaacaattgggatgcagaacttgatctgactcccaggccaggtttgattttgatttgcagtggcagagaggactaattttttactaggttctgagccctgtactgaactctggattgccctgtacttggtggtggtatacagttcagcagtttttagcatatacacgaatttgtgcagccataaccactatctaattctagaacatttttatcacccccaaaagaaatcatgtacccatttgcagtcacttgccattccctcttctccccagccctgggaaaccactgacctaccttatatctctatgaatttgcctaatctggacatttcatataaatgcaattgtacatgtggccttttgtttctggcttctttcacttagcatgttttcaaggttcatttgtgctgtagcatttatcagtactttgttcctttttctagctgagtaacgtgtgggtatatcacattttgtttattcatctgttgagggatgtttgggttgtttctactttttgactattgtgattagtgctgctatgaacattgatgtacagatttttgtgtagatatgttttcaattatcttggggcatcttttatttttaatgtcagttttctatttttaaaaaatctagacaggttggcaaatcatttctgtaaagagtcagtaaatattttagcctttgtggtccatgacattaggtatacagattacaatttctgaactctgccattccagtgtgagagcagccatagataatatgtaaacaaatgagcatggctatgttccaataaaacttttaaaaagcaggggacagattgggcctgtggaccatagtataccaacccttaatctaaatgacacattcacatgatacattattctaaaggcacaaaaagcaaaaattctccctcccacctctgtcttccagctacggggttaccttccttgaagcagttaatgttatgagattttgtgtctccttttagacacagttaataatgagcattaaagtggctatatacta

SEQ ID NO: 128646 - DNA, 1464 bp, Homo sapiens
  Payload ID: 5177
  Gene Symbol: DYNLRB1
  Gene Name: dynein, light chain, roadblock-type 1
  Uniprot ID: Q9NP97
  ENST ID: ENST00000300469
  CDS Start-End: 16-159
ccggatcggtcggaaatggcagaggtggaggagacactgaagcgactgcagagccagaagggagtgcagggaatcatcgtcgtgaacacagaaggaggctgggagcccttgggacactgtggagacaggagcaggccccctgctcagggctgcccctgatcagttgggtggcctgaggcaactcctttccccgcttcagccctcaactgcctcgagtcctgtgatggtccagggaatctcttttgggcacttcttgctctaagacctgaaagacttttgtcactaagagagaaactgtcttctgggactggacattttgactccaaggagacaaccccaggggccaacagccccagctgtgacccccaggcttccacatgaactcacaaaggagaggccctcattcttgccttaaaactgcccctaaagccaagccttttcactgggaagccctagctgcttaccttttggatactagtgagtgctgcttttttgtatactcatggggctgattgcaccatagctgagaacgtggaatgcagaatgagcccacctggctttgaatctgggccctacttaacttatcagctatgtggttttgggcataagccactttctctgttaagttttctcatttgtaaaatgtgggtcataattctgccttcctctaggggaagcttttagaatagtgcctggcatgaaatgcctatgaatgtctcagttagtgtgtgtgtgtctttaacttgcgtcccattctcagggcccccacatcagtgtctcgtttacatctcacacagtgaccctgcgaggcaagggtttgcccagtttgcagatgagaaacccaaagctgagagaggtgtggggaaccgcccaaggtcacccagctgtgaatgaacgtggtcagaacacagaatctgagttggtcacacttcccactgatccatggggcctttaagccctctggaagcttccattaaagatgattatttgaggataattgtattgggatgcctatgatcttatctagggttttcctacccatccccaacattcagctcagctgcctctttcttgaggacaccctcactgatcaccccagcccagccagagtggttgctcctgctcctgcccctgaacctatgacatacccaagtcccaatactttcgagccatctgccactgccttttgacatctctgccttggctagattcaaatggtgtttcataataaaagtctgagtttaagcagctttaccgaaaacgcaagggaagtttcattccatttatacttctccagaccccctgccatcctctgctgctacccacacaggcagaataaaaggcttaaatgtgtaagtcccatgaaggcaaagattggtctcttgtgttcactgctgtctgtagtacttaggatggtgttggcccagagttggtgtttgattaaagtatctgttgaatttttta

SEQ ID NO: 128647 - DNA, 675 bp, Homo sapiens
  Payload ID: 5177
  Gene Symbol: DYNLRB1
  Gene Name: dynein, light chain, roadblock-type 1
  Uniprot ID: Q9NP97
  ENST ID: ENST00000357156
  CDS Start-End: 51-341
cacaggactcgctaagtgttcgctacgcggggctaccggatcggtcggaaatggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgctta

SEQ ID NO: 128648 - DNA, 1044 bp, Homo sapiens
  Payload ID: 5177
  Gene Symbol: DYNLRB1
  Gene Name: dynein, light chain, roadblock-type 1
  ENST ID: ENST00000374846
  CDS Start-End: 264-710
ggaaatggtgagcgtgcgccggggtcttgtggctggcggccgcccaccaccccacgccaggccttcagtcttccgaggatgaggggatctcagagctccggacagggaatcggtggtggctgggcgtggccgggcccgggccccagccgacttgagggtggaacccggcggcggaggcctctaaagcctgaccgaggcggggccgccggatcccgctgccccttgaccggaagcgggagcccagcctcggccaggaagagatgatgggcgaggggtgggcggcggccctgcagcctagagttttggggccttggtgcgcgatggcaaccctggcaacgtttcccgggagctcagtttgtggcaggctctgccaagcactttatgtatcttgtatttcctccgcctcctcccagctctgtgaggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgctta

SEQ ID NO: 128649 - DNA, 497 bp, Homo sapiens
  Payload ID: 5178
  Gene Symbol: DYNLRB2
  Gene Name: dynein, light chain, roadblock-type 2
  Uniprot ID: Q8TF09
  ENST ID: ENST00000305904
  CDS Start-End: 121-411
cagccctgacgcttccgtggggccacttccttttttgtctcctagcaacggcgggtagcgttgttgacatcccgggaggctgtgccgccggcctgagcccagagtttcgcggcctccgcgatggcagaggtggaggaaaccttaaagaggatccagagtcataaaggggttattggaactatggttgtaaatgcagaaggtattcccatccgaacaaccttggacaactcaacaactgttcaatatgcaggccttcttcatcacctgacaatgaaagccaaaagcacagttcgtgatattgatcctcagaacgacctgacttttcttaggatcagatcaaagaaacatgaaatcatggtagctccagataaggaatatcttctgatcgtcattcagaatccatgtgaatagacctgcgatggccaaggctgtttaagcgacactgggttggaaacacttggctctctcatgagtattaaaattctatttcaatctaa

SEQ ID NO: 128650 - DNA, 514 bp, Homo sapiens
  Payload ID: 5178
  Gene Symbol: DYNLRB2
  Gene Name: dynein, light chain, roadblock-type 2
  ENST ID: ENST00000338542
  CDS Start-End: 53-217
atcccgggaggctgtgccgccggcctgagcccagagtttcgcggcctccgcgatggcagaggtggaggaaaccttaaagaggatccagagtcataaaggggttattggaactatggttgtaaatgcagaagatccacgctttgtgaccttcaagtatgcaagacagctgactgccttccagagaaaaagtggccaacaaatcacaataaaagattagcaaggtattcccatccgaacaaccttggacaactcaacaactgttcaatatgcaggccttcttcatcacctgacaatgaaagccaaaagcacagttcgtgatattgatcctcagaacgacctgacttttcttaggatcagatcaaagaaacatgaaatcatggtagctccagataaggaatatcttctgatcgtcattcagaatccatgtgaatagacctgcgatggccaaggctgtttaagcgacactgggttggaaacacttggctctctcatgagtattaaaattctatttcaa

SEQ ID NO: 128651 - DNA, 409 bp, Homo sapiens
  Payload ID: 5178
  Gene Symbol: DYNLRB2
  Gene Name: dynein, light chain, roadblock-type 2
  ENST ID: ENST00000568035
  CDS Start-End: 85-207
gtctcctagcaacggcgggtagcgttgttgacatcccgggaggctgtgccgccggcctgagcccagagtttcgcggcctccgcgatggcagaggtggaggaaaccttaaagaggatccagagtcataaaggggttattggaactatggttgtaaatgcagaagataaggaatatcttctgatcgtcattcagaatccatgtgaatagacctgcgatggccaaggctgtttaagcgacactgggttggaaacacttggctctctcatgagtattaaaattctatttcaatctaactgacccttcaaacattcttttctatttctatatctaaactgttctgcatgtctcatttagtcccttttgattatattgtgaagttgtactttagtgatacaataagtgaattctg

SEQ ID NO: 128652 - DNA, 971 bp, Homo sapiens
  Payload ID: 5178
  Gene Symbol: DYNLRB2
  Gene Name: dynein, light chain, roadblock-type 2
  ENST ID: ENST00000561880
  CDS Start-End: 50-184
ccgggaggctgtgccgccggcctgagcccagagtttcgcggcctccgcgatggcagaggtggaggaaaccttaaagaggatccagagtcataaaggggttattggaactatggttgtaaatgcagaagggaagaagactaacaccatgtcacagagcaagaacttcagagcagactcactatagacaagatgttcaggggagtgcatttcatataaaaatatgttaacttagtactcaagtagtcagttaatggcttctgaaagatttatgcacaaaaatgttcatcatcaccccattagctataaaaaatataaggtaccaaatgaccaaacaataggagattgattatatgtccataaaatagtgaagtatgcagttattaaaaataatgttgatgacattgtcaacaaggacaacttgtatgttataattttgtgaagaaaaaagcaacagtcaagtttgtaaatatagtttcacacaactatacttaaaaatctacgtagcgacaaaaggatttgagggaaataaactaaaattgttaccagagagggataagccatcacttttttctcttctttacaactatcagtgttttccaatacttccacactgtacttattacttttctaatcagaaaaaatattaaccaaaattaaatttcataataggtattcccatccgaacaaccttggacaactcaacaactgttcaatatgcaggccttcttcatcacctgacaatgaaagccaaaagcacagttcgtgatattgatcctcagaacgacctgacttttcttaggatcagatcaaagaaacatgaaatcatggtagctccagataaggaatatcttctgatcgtcattcagaatccatgtgaatagacctgcgatggccaaggctgtttaagcgacactgggttggaaacacttggctctctcatgagtattaaaattctatttcaatctaactga

SEQ ID NO: 128653 - DNA, 492 bp, Homo sapiens
  Payload ID: 5178
  Gene Symbol: DYNLRB2
  Gene Name: dynein, light chain, roadblock-type 2
  ENST ID: ENST00000562982
  CDS Start-End: 32-409
gtggttatcacattaattcgtgcctcaatgaatgaatgaatggacaaacacaggccgggagcctgacccacttccctcttccctcccgggacccactgctccaggattgggcgaacctcaggcagaggtggaggaaaccttaaagaggatccagagtcataaaggggttattggaactatggttgtaaatgcagaaggtattcccatccgaacaaccttggacaactcaacaactgttcaatatgcaggccttcttcatcacctgacaatgaaagccaaaagcacagttcgtgatattgatcctcagaacgacctgacttttcttaggatcagatcaaagaaacatgaaatcatggtagctccagataaggaatatcttctgatcgtcattcagaatccatgtgaatagacctgcgatggccaaggctgtttaagcgacactgggttggaaacacttggctctctcatgagtattaaaattctatttcaatc

SEQ ID NO: 128654 - DNA, 774 bp, Homo sapiens
  Payload ID: 5179
  Gene Symbol: DYNLT1
  Gene Name: dynein, light chain, Tctex-type 1
  ENST ID: ENST00000367085
  CDS Start-End: 31-309
gggagccggaggggacgcgccggaggaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcggtaatggagtcttgtttcttttatatttgcgggatggttttttaacactgatcagaggggcatccagtaccagaaacaacagctaacgtggctcaactcaaggaaggctcctggtgggagtcggtcgtgtgtgtagtatacgttagcgtacgcttgaccatttggctgctggtacaattgcagatcgtatgtgaagcgggatcttacaggaggtcccatcagatgcttttagaacaagtgaagcatagaggaagtgtggacagcccccagctgacagtggctcaacttagaatttttcaactttgatggatttaccagggtattaagtgcatttgcaacttacattttcatatattgttgatttatgatgggtttatgggatgttgtaagtcaaggagcacctataatttgtcaatatagtgagacaaggcaatctgtccctataatttttatcgagaacatcaaccacgtggagctacatacattgtacgtttgctaaaagtggacagaatgacatttgtgttacccagtagacttctctaacaaaaatt

SEQ ID NO: 128655 - DNA, 2891 bp, Homo sapiens
  Payload ID: 5179
  Gene Symbol: DYNLT1
  Gene Name: dynein, light chain, Tctex-type 1
  ENST ID: ENST00000367088
  CDS Start-End: 2174-2377
ttttcgtactgtaaccatatgggaggtgatacagtgcctttcctttgtgattaaggtcacggtagtcacttggaaggatcctttaagcttccagaaatgacttaatctctaagatattgcaaattgttcttcactcagtgagttggttttgtttccaagtccgacttctgagtacagcaagtgaggtggcttcgggcagtcagctcctgaaccccctaaaaagaaagggcagggcctgcagtggacagcagccagacagggaggaagactcactgccaagtcagggttctctgccttgattccctcaggatgcacgttgactgagggccccaggggttgccctctcgaaggcgtgtccagagctacgtacctttcctgggactcagcagtaactttaaacgcttgtgctcatgtgaagagcacattggcaggcaagtgcctgactaatgttattttcaggatgaccttttacccattcagatctaccatgtgtaaaaggaaaactatactcctggcactagattcctgcaggcagcccacctcctgagtcatccagacactgacagagaacagccatgctggcagctggtggttagtcctggagtcggagggcagcactgggaaagaaaaataattacctggagataatgtaatcatcgtacattttacaagtaatggtgctttaaaaaaatctcctcaaggtcaaactgatcctcctaatcagtttacatcatggaagagagaattacatcttaaatggattacttcagcagcttcagttaatttatacaaaaatcaaccaactcattaagcctctctattggttaatgattctagcagccagttgaaatggaagaagagaatgaattctagtttaaagtgaagtcttagattgtggcatgattaaaacaaaacagggccaggtgtggtggcttacgcctgtaatcccagcattttgggaggctgaggcgggaggatcacctgaggtcaggagttcgagaccagcctggccaacatgatgaaaccccatctctactaaaaatacgaaaattagccgggtgtggtggagggcacctgtaatcccagctacttgggaggctgaggcaggagaatcacttgaacctgggaggcagagattgcagtgagctgagattgcgccactgcattccagcctgggctacagagcgacactccgtctcaaaaataaataaataaaaataaaacaatacctttaaattatgtgcatgtattctagtcttctggtttctgaagactgtaatgccatccttggtaaagctgaacagtctagttagattatttctaaggtcttcatttctacattatgttcattacctacatttgcatttatcaatgtagtggaaatatcttttaaataaatcaaacttaactgaatgttcttccttacagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcggtaatggagtcttgtttcttttatatttgcgggatggttttttaacactgatcagaggggcatccagtaccagaaacaacagctaacgtggctcaactcaaggaaggctcctggtgggagtcggtcgtgtgtgtagtatacgttagcgtacgcttgaccatttggctgctggtacaattgcagatcgtatgtgaagcgggatcttacaggaggtcccatcagatgcttttagaacaagtgaagcatagaggaagtgtggacagcccccagctgacagtggctcaacttagaatttttcaactttgatggatttaccagggtattaagtgcatttgcaacttacattttcatatattgttgatttatgatgggtttatgggatgttgtaagtcaaggagcacctataatttgtcaatatagtgagacaaggcaatctgtccctataatttttatcgagaacatcaaccacgtggagctacatacattgtacgtttgctaaaagtggacagaatgacatttgtgttacccagtagacttctctaacaaaaatttgttttaacttaagtgacctgtgtaattatgcagaagaatggagctggattacacacagcaagttcctgcttctgggacagctctactgacggtatgattttcattcatgtttgtgaagttttgttgtgtgaaatatatgactggaagtttcctatctttgaatgcaatgcatgtttatcaccttttaaaacatttaataatagacttgccaaggttctttgtgtagcatagagatgggtacttgaatgttggccttattgtgagtaaaacgtcgtcccccagctttccctgccgtaaatgctgctctcttccctcccgcagggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaa

SEQ ID NO: 128656 - DNA, 726 bp, Homo sapiens
  Payload ID: 5179
  Gene Symbol: DYNLT1
  Gene Name: dynein, light chain, Tctex-type 1
  Uniprot ID: P63172
  ENST ID: ENST00000367089
  CDS Start-End: 32-373
agggagccggaggggacgcgccggaggaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaa

SEQ ID NO: 128657 - DNA, 2217 bp, Homo sapiens
  Payload ID: 5180
  Gene Symbol: DYNLT3
  Gene Name: dynein, light chain, Tctex-type 3
  Uniprot ID: P51808
  ENST ID: ENST00000378578
  CDS Start-End: 128-478
caaaggcggggattgcgtagggaaaggccctaggccataaacgggggtggggcctccccggaggccagtgcgcggccgcggtgctctaccggcgtgtcgctccgccccagggagagccggcgctaccatggaggagtaccatcgccactgcgacgaggttggcttcaatgctgaggaagcccacaatattgtcaaagagtgtgtagatggggttttaggtggtgaagattataatcacaacaacatcaaccagtggactgcaagcatagtggaacaatccttaacacacctggttaagttgggaaaagcctataaatatattgtgacctgtgcagtggtccagaagagcgcatatggctttcacacagccagctcctgtttttgggataccacatctgatggaacctgtaccgtaagatgggagaaccggaccatgaactgtattgtcaacgtttttgccattgctattgttctttaactgactaaaaatgttgggctaaagccattaacttaagaatttgtcagtgtatcctttccaaaaagagtaatagttgtttactagtgtgctagatgaaaagcgtgcaatatgctttaaagctatcaacaaaaactgaatattataagcaagcaatatcatagtaattggcagattagctcatattctatacagcatcgtttaaataggaaaaatttaatgctagcaaaaaataaatttagaaatatggcatgacatgaaaatacaatcttatatttacaccagcttttcactaatattttgtacctaaggtgatggggaactccattcagataataaaattctctttcagctagagaagttaacaggaataaatatatgaacaaaaaagctgcaaggataaatgtggagaaaatgatgagaattagctaacatttttaagtttttttaaactttcttcccctcagttgtacttaatatttagtggaaagtaataatttttttaattttctatcaactaatagtatagtaacaactatgattaacttgtttactttttctgaggattagtaaatcaattttttttaatttcaaatttttggatttacacttgagggtaaattaaatctggtaaactgaatttcctagttaaataaaattagttgcagtatatgatgaacagtgtatgactcaaacagctgccttacaattcactcattccatgtggaacaaacatttatcagatgcctattatgggcatatgtctctgctaagcaccatagttgtcaatgtgctgtgcaaatgctaagttccttttagcaattgttcagttggaagacgtattaatatttggggaaggaaaagaaagtagttgttttacaagggaggaaaaaagtgaatctggttacacatatggaagtaagcaaaatgaaaagcacttattgctttctgacagaattatagatgtaattttaagagttgctcctagcaagttaaaagtgcatataaaatatgcaactcttagttaaaggccttattatcagtcttacctatacaagtagtaaattttgtcattgctttagttacaaccatctgtaaataacttaaaagacttattatgtggggttcaaattgagtggaataaagtatagattaaaagtatacaatccttagcacgttatctcagggcttatgaaatgtaattaaatttattaagaaaatagatgaaaaattagggtacacagctggccaccaaatgcgaagtcaatctgctacttaaccctgaaaacaaaatcagttttgcatattaccactaacactaatacatatagagagcggaaccataactcattgaattttggagaggaataagcttagcgttaatattgacaatattaaggcaatattcttgtaggaatactatgtgcatgtttgatattttgccaaataacaataattaataattgttcaatgtttaagaataatattaacaaaataaaggagtttaatgcagtgatctttgtttttggcacatcaaaaattctcagtcattattcatgtttctttatgctgctggcttttgtgccctggaagatcataatagtgaccaaaatatacatgcagacttgttttttattattgttgtttaagcataatttaagaaaaaaaatttttacctggtgaacttgctatctgctctgtttctagttaaaatataataaatattatcttcctgtgctgta

SEQ ID NO: 128658 - DNA, 920 bp, Homo sapiens
  Payload ID: 5180
  Gene Symbol: DYNLT3
  Gene Name: dynein, light chain, Tctex-type 3
  ENST ID: ENST00000378581
  CDS Start-End: 5-463
taccatggaggagtaccatcgccactgcgacgaggttggcttcaatgctgaggaagcccacaatattgtcaaagagtgtgtagatggggttttaggtggtgaagattataatcacaacaacatcaaccagtggactgcaagcatagtggaacaatccttaacacacctggttaagttgggaaaagcctataaatatattgtgacctgtgcagtggtccagaagagcgcatatggctttcacacagccagctcctgtttttgggataccacatctgatggaacctgtaccgtaagatgggagaaccggaccatgaactgtggagtcttgctctgtcgcccaggctggagtgcagtgatgcaatttcggctcactgcaacctctgcctcccaggttcaagtgattcttctgcctcagcctcccgagtacctggaactacaggcacacgccataacgcctggctaatttttatatttttagtagagatggggttttgccatgttggccaggatggtctcgaactcctgacctcaagtgatccacccacctcggcctctcaaaatgctgggattacaagcgcgagccaccctgcccggccgaaaagatctcaaacattcatctcttacaagatttagatgactatcatcaatatgccttaacatcagtagtttaggagactctagcccactttgtctagttgcaaactgtaattctccctgtggtcccactgaatatcattccacagcattcttggatatatatgatgtattgacaattcaggtctagatagaaatggcccctattgcttcatgaagaatatcctttccccaaatgtcttctgaggagctcaagattaaagctagtatcctgtacagacacttgcaggactgctagtatgatatatattgaccctatgggagac

SEQ ID NO: 128659 - DNA, 719 bp, Homo sapiens
  Payload ID: 5180
  Gene Symbol: DYNLT3
  Gene Name: dynein, light chain, Tctex-type 3
  ENST ID: ENST00000432389
  CDS Start-End: 319-687
ctcccagcgagggcggtcccaagagttggggtgcggcgtcctccgagcccgggtcctctcccctgggcccgggatccgccccgcccgacccgttctccccaccccaaagtcctgagattcggggtgggaggggtggccaggagcgcgcggatcagacggtggggtcggggcagggttgggaggacgaggcctgacttgggtgcgaggagtgggcatggggtgacgggcgccgccctcctaccgggcgggcctcgaaaacgggtcttcccgctgctgcctccgtcccttggcttcctcagcgcgggtgctgcagcccccatggctcggagtctcggggtcctggtggcactgccattcccgctcccggttggcttcaatgctgaggaagcccacaatattgtcaaagagtgtgtagatggggttttaggtggtgaagattataatcacaacaacatcaaccagtggactgcaagcatagtggaacaatccttaacacacctggttaagttgggaaaagcctataaatatattgtgacctgtgcagtggtccagaagagcgcatatggctttcacacagccagctcctgtttttgggataccacatctgatggaacctgtaccgtaagatgggagaaccggaccatgaactgtattgtcaacgtttttgccattgctattgttctttaactgactaaaaatgttgggctaaagccattaac

SEQ ID NO: 128660 - DNA, 2079 bp, Homo sapiens
  Payload ID: 5181
  Gene Symbol: DBNDD1
  Gene Name: dysbindin (dystrobrevin binding protein 1) domain containing 1
  Uniprot ID: Q9H9R9
  ENST ID: ENST00000002501
  CDS Start-End: 133-609
gccgcggccccccggttgctgccccgatgcgctgcgcccggagccggggccgagtcgctgccgcagctgttggggcgcccgggccaggcgacgccgccgtcgcccgtgcccctcccagaccgcaccggccgcatggagcccccggagggcgccggcaccggagagatcgttaaggaggctgaggtgccgcaggctgcgctgggcgtcccagcccaggggacaggggacaatggccacacgcctgtggaggaggaggtcgggggcatcccagtaccagcaccggggctcctgcaggtcacggagaggaggcagcctctgagcagcgtctcctctctggaggtccacttcgacctcctggacctcactgagctcaccgacatgtcggaccaggagctggccgaggtctttgctgactcggacgacgagaacctcaacaccgagtccccagcaggtctgcacccgctgccccgggccggctacctgcgctccccttcctggacgaggacaagggctgagcagagccacgagaagcagcccctaggcgaccccgagcggcaggccacagtcctggacacgtttctcactgtggagaggccccaggaggactagaccatctccacctgccccagctcctgcagggatggggtccgaacacgatggcagatctgggcagtgctgacccagcagacacacttcacccgcccacgaggctccagccgtcacctcctgacacacaccctgggggcagctctctgccagccccgagaccggccttgtctgctgggcacgggtcttcgcctcacttggagaccagccggctttcctgggggacacacggggcccccggatgcctctgggagccccagcacaagcacagcccagtggccttacgtccagctcgttcctgggccccgagtcaggaagacagcgtcacggagtcactgccaggaacgtgctgaggaatggagtggcccacggcggccttggggtgaaggggacccaggcctgtgacagccactccaggaactcctgggggtgctccaacctccgcgttttcctgtgctgccaagctcagaagccagaggcgggtttggtagtggctaatgggacaatgtgctgtccagcaaagcacacatggagaagcggccccaaaattcccaccttgatttccatcctgccccttcttctactccacggaggcgctgtctcactagggtcccctccccaaggctcagctctaagacctgcacctgcttctcttggcccctgcgtgacagacaagtccattccctccttagctcagaacaccaaatatcaccagactgcctaagagacttgatgacacctcccggaatgctctcggggtggggttcacctctccttgtcctgcacccactgctaggccacattctcgtttctgctcacatcccattgcccggctacaaggcctgcccacggcccttaaacttgctgggcaggtttggagcccatgggaccccgtgggtctctgtccaggagcagcagaggaggctgacaggccctgctccctctgctctgggggtgtctgggagccccagctcacaccctcccaatgcttatatgctgaagctcacagaatgggcttcttgcctgacagcaagtcaaagaatgagtttaatatcaaagtgtaagcttactttccatccccaagccagcctgccccctgccccatttcccatgagcacacttctggggaaggaaaacaggctcctggccttcactctcagcagagctttggagatgccccaggcatgccctgagctccttctgtgtacctgctcccacttctgagccacccgctgcccctccgcactgctggcaaacccagttcctgcctcagccaggtctccttccctggtttccagtcacacagagcccagcagctttctctttcagtcccataagggcagccttgtgtccctggccacacttccacccgccagggtcttcctccccatctttccatccttcctgctgagcttccacagagctcgtttgcaaacagggggattaaagcatcactgcgcattcgaaggcctg

SEQ ID NO: 128661 - DNA, 2081 bp, Homo sapiens
  Payload ID: 5181
  Gene Symbol: DBNDD1
  Gene Name: dysbindin (dystrobrevin binding protein 1) domain containing 1
  Uniprot ID: Q9H9R9
  ENST ID: ENST00000304733
  CDS Start-End: 75-611
gtgagccgagattgcaccactgcactccagcctgggtgacagagcgagactccatctaaaaaaaataaataaacatgggagaaacctggaagaatatttgctcaactgtgaggcatggttggtggctaagggatcacagaatggcaggcctgcctattcctcctgagatcgttaaggaggctgaggtgccgcaggctgcgctgggcgtcccagcccaggggacaggggacaatggccacacgcctgtggaggaggaggtcgggggcatcccagtaccagcaccggggctcctgcaggtcacggagaggaggcagcctctgagcagcgtctcctctctggaggtccacttcgacctcctggacctcactgagctcaccgacatgtcggaccaggagctggccgaggtctttgctgactcggacgacgagaacctcaacaccgagtccccagcaggtctgcacccgctgccccgggccggctacctgcgctccccttcctggacgaggacaagggctgagcagagccacgagaagcagcccctaggcgaccccgagcggcaggccacagtcctggacacgtttctcactgtggagaggccccaggaggactagaccatctccacctgccccagctcctgcagggatggggtccgaacacgatggcagatctgggcagtgctgacccagcagacacacttcacccgcccacgaggctccagccgtcacctcctgacacacaccctgggggcagctctctgccagccccgagaccggccttgtctgctgggcacgggtcttcgcctcacttggagaccagccggctttcctgggggacacacggggcccccggatgcctctgggagccccagcacaagcacagcccagtggccttacgtccagctcgttcctgggccccgagtcaggaagacagcgtcacggagtcactgccaggaacgtgctgaggaatggagtggcccacggcggccttggggtgaaggggacccaggcctgtgacagccactccaggaactcctgggggtgctccaacctccgcgttttcctgtgctgccaagctcagaagccagaggcgggtttggtagtggctaatgggacaatgtgctgtccagcaaagcacacatggagaagcggccccaaaattcccaccttgatttccatcctgccccttcttctactccacggaggcgctgtctcactagggtcccctccccaaggctcagctctaagacctgcacctgcttctcttggcccctgcgtgacagacaagtccattccctccttagctcagaacaccaaatatcaccagactgcctaagagacttgatgacacctcccggaatgctctcggggtggggttcacctctccttgtcctgcacccactgctaggccacattctcgtttctgctcacatcccattgcccggctacaaggcctgcccacggcccttaaacttgctgggcaggtttggagcccatgggaccccgtgggtctctgtccaggagcagcagaggaggctgacaggccctgctccctctgctctgggggtgtctgggagccccagctcacaccctcccaatgcttatatgctgaagctcacagaatgggcttcttgcctgacagcaagtcaaagaatgagtttaatatcaaagtgtaagcttactttccatccccaagccagcctgccccctgccccatttcccatgagcacacttctggggaaggaaaacaggctcctggccttcactctcagcagagctttggagatgccccaggcatgccctgagctccttctgtgtacctgctcccacttctgagccacccgctgcccctccgcactgctggcaaacccagttcctgcctcagccaggtctccttccctggtttccagtcacacagagcccagcagctttctctttcagtcccataagggcagccttgtgtccctggccacacttccacccgccagggtcttcctccccatctttccatccttcctgctgagcttccacagagctcgtttgcaaacagggggattaaagcatcactgcgcattcgaaggcctg

SEQ ID NO: 128662 - DNA, 2689 bp, Homo sapiens
  Payload ID: 5181
  Gene Symbol: DBNDD1
  Gene Name: dysbindin (dystrobrevin binding protein 1) domain containing 1
  ENST ID: ENST00000392973
  CDS Start-End: 733-1227
tagccgggcgtgctggtgcatgcctgtaatcccatctactcagggggatgaggcaggagaatcgctcaaacccaaggggcagaggttgcagtgagccgagattgcaccactgcactccagcctgggtgacagagcgagactccatctaaaaaaaataaataaacatgggagaaacctggaagaatatttgctcaactgtgaggcatggttggtggctaagggatcacagaatggcaggcctgcctattcctcctggtttgtaactttcatttaatgagaatgtattattctgaactcaaatacgacatcagtttttaaaaggaaaagtcagtccacagtggagaggggctgttctggtttgaaggggaccaagaggctggacatggaaatccatgggcgatccttcaggggaccctgggccgagctagaaatcagaggccaggacggcactggaatgcagccacgcgggccctggtgggacttccacgcctgcatggtcggctttcatgggtgcttgcgtaccaaaggtgatctggatctcagattccttgttcactaggggaggccagggcccaaggggaaggagcagcctccttgaagcccctcaaccccttgtctgggtccaggcatgaggccacaagcccagccatcccatcacctgctggtcactgcccagagtttcaaaggactggatgtgccaagtcctcacacccagccccgcgtcctggggggatgtgggagccctgtggatctcaaggtgacactgtgtctttggatgcagagatcgttaaggaggctgaggtgccgcaggctgcgctgggcgtcccagcccaggggacaggggacaatggccacacgcctgtggaggaggaggtcgggggcatcccagtaccagcaccggggctcctgcaggtcacggagaggaggcagcctctgagcagcgtctcctctctggaggtccacttcgacctcctggacctcactgagctcaccgacatgtcggaccaggagctggccgaggtctttgctgactcggacgacgagaacctcaacaccgagtccccagcaggtctgcacccgctgccccgggccggctacctgcgctccccttcctggacgaggacaagggctgagcagagccacgagaagcagcccctaggcgaccccgagcggcaggccacagtcctggacacgtttctcactgtggagaggccccaggaggactagaccatctccacctgccccagctcctgcagggatggggtccgaacacgatggcagatctgggcagtgctgacccagcagacacacttcacccgcccacgaggctccagccgtcacctcctgacacacaccctgggggcagctctctgccagccccgagaccggccttgtctgctgggcacgggtcttcgcctcacttggagaccagccggctttcctgggggacacacggggcccccggatgcctctgggagccccagcacaagcacagcccagtggccttacgtccagctcgttcctgggccccgagtcaggaagacagcgtcacggagtcactgccaggaacgtgctgaggaatggagtggcccacggcggccttggggtgaaggggacccaggcctgtgacagccactccaggaactcctgggggtgctccaacctccgcgttttcctgtgctgccaagctcagaagccagaggcgggtttggtagtggctaatgggacaatgtgctgtccagcaaagcacacatggagaagcggccccaaaattcccaccttgatttccatcctgccccttcttctactccacggaggcgctgtctcactagggtcccctccccaaggctcagctctaagacctgcacctgcttctcttggcccctgcgtgacagacaagtccattccctccttagctcagaacaccaaatatcaccagactgcctaagagacttgatgacacctcccggaatgctctcggggtggggttcacctctccttgtcctgcacccactgctaggccacattctcgtttctgctcacatcccattgcccggctacaaggcctgcccacggcccttaaacttgctgggcaggtttggagcccatgggaccccgtgggtctctgtccaggagcagcagaggaggctgacaggccctgctccctctgctctgggggtgtctgggagccccagctcacaccctcccaatgcttatatgctgaagctcacagaatgggcttcttgcctgacagcaagtcaaagaatgagtttaatatcaaagtgtaagcttactttccatccccaagccagcctgccccctgccccatttcccatgagcacacttctggggaaggaaaacaggctcctggccttcactctcagcagagctttggagatgccccaggcatgccctgagctccttctgtgtacctgctcccacttctgagccacccgctgcccctccgcactgctggcaaacccagttcctgcctcagccaggtctccttccctggtttccagtcacacagagcccagcagctttctctttcagtcccataagggcagccttgtgtccctggccacacttccacccgccagggtcttcctccccatctttccatccttcctgctgagcttccacagagctcgtttgcaaacagggggattaaagcatcactgcgcattcg

SEQ ID NO: 128663 - DNA, 567 bp, Homo sapiens
  Payload ID: 5181
  Gene Symbol: DBNDD1
  Gene Name: dysbindin (dystrobrevin binding protein 1) domain containing 1
  ENST ID: ENST00000568330
  CDS Start-End: 1-239
atccagggcgctctgtgagtctgtcattacccagcgcgagtcaggcccctcctgtgcccctcgccagccccgaggggcgcccgcacacagtcggcgccccacacgcaagtacctggaagagaacaagaggacgccagcgggcgcggccgccaaatgccagtggaaaggtggaaaccagattccgcgagagccccgtccagcccgcccaacccccaggcctgaaacgggccatgccatgacacagcactcggcttctcagacaggagagatcgttaaggaggctgaggtgccgcaggctgcgctgggcgtcccagcccaggggacaggggacaatggccacacgcctgtggaggaggaggtcgggggcatcccagtaccagcaccggggctcctgcaggtcacggagaggaggcagcctctgagcagcgtctcctctctggaggtccacttcgacctcctggacctcactgagctcaccgacatgtcggaccaggagctggccgaggtctttgctgactcggacgacgagaacctcaacaccgagtccccagcaggtctgcacccgct

SEQ ID NO: 128664 - DNA, 993 bp, Homo sapiens
  Payload ID: 5181
  Gene Symbol: DBNDD1
  Gene Name: dysbindin (dystrobrevin binding protein 1) domain containing 1
  Uniprot ID: Q9H9R9
  ENST ID: ENST00000568838
  CDS Start-End: 11-847
ttgcttcaaaatgacccagcagtggagggaagtgaatgaggacagagaagcagtggcccaggccaggagctggcaatcgctgaatctgggcgatagggacatgggggtcagtttcatcgaaactgccttggcgctctctgcagcccgggcccgccgccctctccttacctcccatcccccatcccgccccttccagcctcccaagcacacgccctcgcccccacccgccccccgcgttaattcgcgccatccagggcgctctgtgagtctgtcattacccagcgcgagtcaggcccctcctgtgcccctcgccagccccgaggggcgcccgcacacagtcggcgccccacacgcaagtacctggaagagaacaagaggacgccagcgggcgcggccgccaaagatcgttaaggaggctgaggtgccgcaggctgcgctgggcgtcccagcccaggggacaggggacaatggccacacgcctgtggaggaggaggtcgggggcatcccagtaccagcaccggggctcctgcaggtcacggagaggaggcagcctctgagcagcgtctcctctctggaggtccacttcgacctcctggacctcactgagctcaccgacatgtcggaccaggagctggccgaggtctttgctgactcggacgacgagaacctcaacaccgagtccccagcaggtctgcacccgctgccccgggccggctacctgcgctccccttcctggacgaggacaagggctgagcagagccacgagaagcagcccctaggcgaccccgagcggcaggccacagtcctggacacgtttctcactgtggagaggccccaggaggactagaccatctccacctgccccagctcctgcagggatggggtccgaacacgatggcagatctgggcagtgctgacccagcagacacacttcacccgcccacgaggctccagccgtcacctcctgacacacaccctgggggcagctctctg

SEQ ID NO: 128665 - DNA, 1036 bp, Homo sapiens
  Payload ID: 5182
  Gene Symbol: DBNDD2
  Gene Name: dysbindin (dystrobrevin binding protein 1) domain containing 2
  Uniprot ID: Q9BQY9
  ENST ID: ENST00000357275
  CDS Start-End: 81-566
gtgcgtcctctggagaagtgcgcgcgtgtaagtgtggcgagtgtggccaagggtgccggaggcagggttcgggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 128666 - DNA, 1078 bp, Homo sapiens
  Payload ID: 5182
  Gene Symbol: DBNDD2
  Gene Name: dysbindin (dystrobrevin binding protein 1) domain containing 2
  Uniprot ID: Q9BQY9
  ENST ID: ENST00000360981
  CDS Start-End: 123-608
cccgggagccctggaggcgcagccccaccccggccggcgcggctcgctcccacgcccccgccgcggcctcgctggagcggacggactgagtcagagggggcgccagcgctgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 128667 - DNA, 1417 bp, Homo sapiens
  Payload ID: 5182
  Gene Symbol: DBNDD2
  Gene Name: dysbindin (dystrobrevin binding protein 1) domain containing 2
  Uniprot ID: Q9BQY9
  ENST ID: ENST00000372710
  CDS Start-End: 156-947
agcactggaggaagggaaccctccaccctgagatctctgtctctatcctatcctgtccctggccttctgaggcaagcggggccaattaaggggaaaacgtacctcctccatttgtgctgaaccaatccctccaacccctctcaggagggcatgatatggagagttgggcattggctgtgttccctgaatacagagtatctctcttgtggtgcctggaactggcatcccctttgtggagcttagggcaagccccgcctctgcatgagacttggtttgtgggacacacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 128668 - DNA, 1537 bp, Homo sapiens
  Payload ID: 5182
  Gene Symbol: DBNDD2
  Gene Name: dysbindin (dystrobrevin binding protein 1) domain containing 2
  Uniprot ID: Q9BQY9
  ENST ID: ENST00000372712
  CDS Start-End: 582-1067
tagcgttgtgacctgggcggcagctctaagagcctttcccgggaatcggcgtcagcgcctcgctcctccgccgccagcccgcggccgcacggtctccccagacttccgtggccctgccttggccagtcggggttgggtccctctccacctctgtggcgcccgtggagctggccagggtctgggatacgctgggtgcagatgaggtggggaaggcagtctgcggaggatgacgtctgatcctcaagctagaaactcccttgcctctggtgatgggctcagagcagaacgccgggaaggagatgagcgaatgggaatgaatgcaccgacctgggctggcccatagcctcagtgctctggcagggtctcagcttctcagccctaggggtcaggaggcctgctctgaactggacccagaacccgcctttccaattgctcctcactgactaatggggagataagtcagtgagatgtgtcccaggagggggacgcataaagagctgttggagttcaaaggaaagatggtagtctcctaaatagctcaccttcacaagcagggtcttgtatttgaggcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 128669 - DNA, 1207 bp, Homo sapiens
  Payload ID: 5182
  Gene Symbol: DBNDD2
  Gene Name: dysbindin (dystrobrevin binding protein 1) domain containing 2
  Uniprot ID: Q9BQY9
  ENST ID: ENST00000372717
  CDS Start-End: 154-492
ctcgttcccggctcccagggcccgtcggtcccccgggagccctggaggcgcagccccaccccggccggcgcggctcgctcccacgcccccgccgcggcctcgctggagcggacggactgagtcagagggggcgccagcgctgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggtatgcccctctgctttggggacttcagtgccagtcagccagagccggatgtcaggctctgaaacgaggctacaaggctgggctggggaagtacacaaggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 128670 - DNA, 1481 bp, Homo sapiens
  Payload ID: 5182
  Gene Symbol: DBNDD2
  Gene Name: dysbindin (dystrobrevin binding protein 1) domain containing 2
  Uniprot ID: Q9BQY9
  ENST ID: ENST00000372720
  CDS Start-End: 232-1011
cgagtgtggccaagggtgccggaggcagggttcgggtgcgtagtcgttgcgtgggcgctgcccaaaaggcgcagagcatcaagtgtgcgtgggcagaaccggcgcgggcgcccgccgcgggtctgcgcggggcgggggcgcagcaagtgcatccgagcgagcggagactagcgcaccggcgtcggtggcgagggtggtgcagaggagtccggctgggcggagggaggaaggatgggtgcgggtaactttttgaccgccttggaagtaccagtagccgcgctcgcaggggctgcctccgaccgccgggcgagctgcgagcgagtgagcccgccaccgcccctcccccacttccgcctcccgcctcttcctcgttcccggctcccagggcccgtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 128671 - DNA, 1202 bp, Homo sapiens
  Payload ID: 5182
  Gene Symbol: DBNDD2
  Gene Name: dysbindin (dystrobrevin binding protein 1) domain containing 2
  Uniprot ID: Q9BQY9
  ENST ID: ENST00000372722
  CDS Start-End: 149-487
agccgggcgagtcccagggcaggggtcctccgccgccttgcacctgccctgctgggcggcaccgggtcagtgccctgccccctcctgcgggtcccaactctctctttcccatcgtgcgtcctctggagaagtgcgcgcgtgagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggtatgcccctctgctttggggacttcagtgccagtcagccagagccggatgtcaggctctgaaacgaggctacaaggctgggctggggaagtacacaaggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 128672 - DNA, 1118 bp, Homo sapiens
  Payload ID: 5182
  Gene Symbol: DBNDD2
  Gene Name: dysbindin (dystrobrevin binding protein 1) domain containing 2
  Uniprot ID: Q9BQY9
  ENST ID: ENST00000372723
  CDS Start-End: 163-648
caggaatcaggggcagccgggcgagtcccagggcaggggtcctccgccgccttgcacctgccctgctgggcggcaccgggtcagtgccctgccccctcctgcgggtcccaactctctctttcccatcgtgcgtcctctggagaagtgcgcgcgtgagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 128673 - DNA, 1233 bp, Homo sapiens
  Payload ID: 5182
  Gene Symbol: DBNDD2
  Gene Name: dysbindin (dystrobrevin binding protein 1) domain containing 2
  ENST ID: ENST00000443296
  CDS Start-End: 1-518
acacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggtatgcccctctgctttggggacttcagtgccagtcagccagagccggatgtcaggctctgaaacgaggctacaaggctgggctggggaagtacacaaggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 128674 - DNA, 6796 bp, Homo sapiens
  Payload ID: 5183
  Gene Symbol: DYSF
  Gene Name: dysferlin
  Uniprot ID: O75923
  ENST ID: ENST00000258104
  CDS Start-End: 278-6520
gggtggaagatgagcagaagcccctgttctcggaacgccggctgacaagcggggtgagcgcagccggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagaggagcctgcaggtgctgtcaagccttcgaaagcctcagacttggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccaggaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccacacagca

SEQ ID NO: 128675 - DNA, 6543 bp, Homo sapiens
  Payload ID: 5183
  Gene Symbol: DYSF
  Gene Name: dysferlin
  Uniprot ID: O75923
  ENST ID: ENST00000394120
  CDS Start-End: 142-6387
tctccgcggaggagcagcgaaggcgacagctctcttggcgcggctgcctgggagccgggcgcttgctgggtgggtgctcgggcccggtgctcccgctcccgccctgactgcgcgcctgtgtgccgccggggctgcccagccatgctgtgctgcctgctggtgagggccagcaacctccccagtgcgaagaaggaccggcgcagcgaccctgtcgcaagcctgactttccgaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagaggagcctgcaggtgctgtcaagccttcgaaagcctcagacttggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccaggaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 128676 - DNA, 6564 bp, Homo sapiens
  Payload ID: 5183
  Gene Symbol: DYSF
  Gene Name: dysferlin
  Uniprot ID: O75923
  ENST ID: ENST00000409744
  CDS Start-End: 142-6408
tctccgcggaggagcagcgaaggcgacagctctcttggcgcggctgcctgggagccgggcgcttgctgggtgggtgctcgggcccggtgctcccgctcccgccctgactgcgcgcctgtgtgccgccggggctgcccagccatgctgtgctgcctgctggtgagggccagcaacctccccagtgcgaagaaggaccggcgcagcgaccctgtcgcaagcctgactttccgaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagtggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 128677 - DNA, 6606 bp, Homo sapiens
  Payload ID: 5183
  Gene Symbol: DYSF
  Gene Name: dysferlin
  Uniprot ID: O75923
  ENST ID: ENST00000409366
  CDS Start-End: 142-6450
tctccgcggaggagcagcgaaggcgacagctctcttggcgcggctgcctgggagccgggcgcttgctgggtgggtgctcgggcccggtgctcccgctcccgccctgactgcgcgcctgtgtgccgccggggctgcccagccatgctgtgctgcctgctggtgagggccagcaacctccccagtgcgaagaaggaccggcgcagcgaccctgtcgcaagcctgactttccgaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagaggagcctgcaggtgctgtcaagccttcgaaagcctcagacttggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 128678 - DNA, 6790 bp, Homo sapiens
  Payload ID: 5183
  Gene Symbol: DYSF
  Gene Name: dysferlin
  Uniprot ID: O75923
  ENST ID: ENST00000409582
  CDS Start-End: 278-6634
gggtggaagatgagcagaagcccctgttctcggaacgccggctgacaagcggggtgagcgcagccggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcaggcgggggacagagccgggccgagacttggtccctgctcagtgacagcaccatggacacgagatactctggaaagaagtggccggcccccacggacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagtggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 128679 - DNA, 6594 bp, Homo sapiens
  Payload ID: 5183
  Gene Symbol: DYSF
  Gene Name: dysferlin
  Uniprot ID: O75923
  ENST ID: ENST00000410041
  CDS Start-End: 142-6438
tctccgcggaggagcagcgaaggcgacagctctcttggcgcggctgcctgggagccgggcgcttgctgggtgggtgctcgggcccggtgctcccgctcccgccctgactgcgcgcctgtgtgccgccggggctgcccagccatgctgtgctgcctgctggtgagggccagcaacctccccagtgcgaagaaggaccggcgcagcgaccctgtcgcaagcctgactttccgaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcaggcgggggacagagccgggccgagacttggtccctgctcagtgacagcaccatggacacgagatactctggaaagaagtggccggcccccacggacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagtggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccaggaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 128680 - DNA, 6636 bp, Homo sapiens
  Payload ID: 5183
  Gene Symbol: DYSF
  Gene Name: dysferlin
  Uniprot ID: O75923
  ENST ID: ENST00000409651
  CDS Start-End: 142-6480
tctccgcggaggagcagcgaaggcgacagctctcttggcgcggctgcctgggagccgggcgcttgctgggtgggtgctcgggcccggtgctcccgctcccgccctgactgcgcgcctgtgtgccgccggggctgcccagccatgctgtgctgcctgctggtgagggccagcaacctccccagtgcgaagaaggaccggcgcagcgaccctgtcgcaagcctgactttccgaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcaggcgggggacagagccgggccgagacttggtccctgctcagtgacagcaccatggacacgagatactctggaaagaagtggccggcccccacggacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagaggagcctgcaggtgctgtcaagccttcgaaagcctcagacttggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccaggaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 128681 - DNA, 6657 bp, Homo sapiens
  Payload ID: 5183
  Gene Symbol: DYSF
  Gene Name: dysferlin
  Uniprot ID: O75923
  ENST ID: ENST00000410020
  CDS Start-End: 142-6501
tctccgcggaggagcagcgaaggcgacagctctcttggcgcggctgcctgggagccgggcgcttgctgggtgggtgctcgggcccggtgctcccgctcccgccctgactgcgcgcctgtgtgccgccggggctgcccagccatgctgtgctgcctgctggtgagggccagcaacctccccagtgcgaagaaggaccggcgcagcgaccctgtcgcaagcctgactttccgaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcaggcgggggacagagccgggccgagacttggtccctgctcagtgacagcaccatggacacgagatactctggaaagaagtggccggcccccacggacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagtggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 128682 - DNA, 6727 bp, Homo sapiens
  Payload ID: 5183
  Gene Symbol: DYSF
  Gene Name: dysferlin
  Uniprot ID: O75923
  ENST ID: ENST00000409762
  CDS Start-End: 278-6571
gggtggaagatgagcagaagcccctgttctcggaacgccggctgacaagcggggtgagcgcagccggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcaggcgggggacagagccgggccgagacttggtccctgctcagtgacagcaccatggacacgagatactctggaaagaagtggccggcccccacggacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagtggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccaggaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 128683 - DNA, 6739 bp, Homo sapiens
  Payload ID: 5183
  Gene Symbol: DYSF
  Gene Name: dysferlin
  Uniprot ID: O75923
  ENST ID: ENST00000429174
  CDS Start-End: 278-6583
gggtggaagatgagcagaagcccctgttctcggaacgccggctgacaagcggggtgagcgcagccggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagaggagcctgcaggtgctgtcaagccttcgaaagcctcagacttggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 128684 - DNA, 6769 bp, Homo sapiens
  Payload ID: 5183
  Gene Symbol: DYSF
  Gene Name: dysferlin
  Uniprot ID: O75923
  ENST ID: ENST00000413539
  CDS Start-End: 278-6613
gggtggaagatgagcagaagcccctgttctcggaacgccggctgacaagcggggtgagcgcagccggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcaggcgggggacagagccgggccgagacttggtccctgctcagtgacagcaccatggacacgagatactctggaaagaagtggccggcccccacggacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagaggagcctgcaggtgctgtcaagccttcgaaagcctcagacttggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccaggaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 128685 - DNA, 2577 bp, Homo sapiens
  Payload ID: 5184
  Gene Symbol: DKC1
  Gene Name: dyskeratosis congenita 1, dyskerin
  Uniprot ID: O60832
  ENST ID: ENST00000369550
  CDS Start-End: 211-1755
agcaaatcgcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaagtaattattttgccaaagaaacataagaagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtacgctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtga

SEQ ID NO: 128686 - DNA, 670 bp, Homo sapiens
  Payload ID: 5184
  Gene Symbol: DKC1
  Gene Name: dyskeratosis congenita 1, dyskerin
  ENST ID: ENST00000412124
  CDS Start-End: 1-229
tgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaa

SEQ ID NO: 128687 - DNA, 686 bp, Homo sapiens
  Payload ID: 5184
  Gene Symbol: DKC1
  Gene Name: dyskeratosis congenita 1, dyskerin
  ENST ID: ENST00000437719
  CDS Start-End: 1-686
gaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtacgctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggtgctgcttttcttttgtgtgtgtgtatcttaggaatcttttgggtgagttgtgaggctggcacctacattcggacattatgtgtgcacc

SEQ ID NO: 128688 - DNA, 851 bp, Homo sapiens
  Payload ID: 5184
  Gene Symbol: DKC1
  Gene Name: dyskeratosis congenita 1, dyskerin
  ENST ID: ENST00000413910
  CDS Start-End: 76-851
gggaccaaggcggcgggagtctgcggtcgttccctcggctgtggaccgggcggcacgcacgcggtgcagggtaacatggcggatgcggaagtaattattttgccaaagaaacataagaagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtacgctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggaccacatggtgacaatgcatgatgtgcttgatgctcagtggctgtatgataaccacaaggatgagagttacctgcggcgagttgtttaccctttggaaaagctgttgacatctcataaacggct

SEQ ID NO: 128689 - DNA, 843 bp, Homo sapiens
  Payload ID: 5184
  Gene Symbol: DKC1
  Gene Name: dyskeratosis congenita 1, dyskerin
  ENST ID: ENST00000426673
  CDS Start-End: 1-623
gaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacaggtgaggatgggaaggtagagcccacttgccatctggacgcaggagtacatggacaacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaa

SEQ ID NO: 128690 - DNA, 708 bp, Homo sapiens
  Payload ID: 5184
  Gene Symbol: DKC1
  Gene Name: dyskeratosis congenita 1, dyskerin
  ENST ID: ENST00000452771
  CDS Start-End: 1-510
aagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtacgctggatcccaaggtgactggttgtttaatcgtgtgcatagaacgagccactcgcttggtgaagtcacaacagagtgcaggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggct

SEQ ID NO: 128691 - DNA, 3079 bp, Homo sapiens
  Payload ID: 5184
  Gene Symbol: DKC1
  Gene Name: dyskeratosis congenita 1, dyskerin
  Uniprot ID: O60832
  ENST ID: ENST00000620277
  CDS Start-End: 225-1487
gtactggccgagccagcaaatcgcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaagtaattattttgccaaagaaacataagaagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtacgctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacaggtgagggcaggatgtttcagagccggggtgggtagagacggcacacttgctgccttgatgcaggagtatgtcaacaacaggtgaggatgggaaggtagagcccacttgccatctggacgcaggagtacatggacaacaggtgaggaacaggtgagcatggaggttgtagagcccaggggagggggagtcacttggtttggggcaaacttgctaaatgcaggaccacaggaaccagctcttcagctcccgtgagattttggctgcccaggccagttaggggtgtgggcctgcacggcagacagttatccctttctagtctggctcgtgggactctagagggagtcagtctgcaacagtaagtggtgagttcttctgtccagcgtcagtattttgatggtggctttagacttgccagataacactacataacatcagtactgccctggaaagccattcagtgaatttgacctattgctacctctttttcagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtg

SEQ ID NO: 128692 - DNA, 1897 bp, Homo sapiens
  Payload ID: 5185
  Gene Symbol: DYX1C1
  Gene Name: dyslexia susceptibility 1 candidate 1
  Uniprot ID: Q8WXU2
  ENST ID: ENST00000348518
  CDS Start-End: 273-1535
ttttttttctcaagcagagggtatgggtctacttctttgaacattcgctcagatcgtaaggtaaccccaagaatcggcatcactctctggtctgggcgcctggatagtcacgcatggagtccgcgaggtgctggcgccggagcacgctgggaacgccgggctcccggccggcctgacccggaagggctggcgcatggtaaccccagcttccctagcaaccaagcaggcgcaagaagcaaccagccgcgctatccgctcccgttgctaccggaatgcctcttcaggttagcgattacagctggcagcagacgaagactgcggtctttctgtctctgcccctcaaaggcgtgtgcgtcagagacacggacgtgttctgcacggaaaactatctgaaggtcaactttcctccatttttatttgaggcatttctttatgctcccatagacgatgagagcagcaaagcaaagattgggaatgacaccattgtcttcaccttgtataaaaaagaagcggccatgtgggagaccctttctgtgacgggtgttgacaaagagatgatgcaaagaattagagaaaaatctattttacaagcacaagagagagcaaaagaagctacagaagcaaaagctgcagcaaagcgggaagatcaaaaatacgcactaagtgtcatgatgaagattgaagaagaagagaggaaaaaaatagaagatatgaaagaaaatgaacggataaaagccactaaagcattggaagcctggaaagaatatcaaagaaaagctgaggagcaaaaaaaaattcagagagaagagaaattatgtcaaaaagaaaagcaaattaaagaagaaagaaaaaaaataaaatataagagtcttactagaaatttggcatctagaaatcttgctccaaaagggagaaattcagaaaatatatttactgagaagttaaaggaagacagtattcctgctcctcgctctgttggcagtattaaaatcaactttacccctcgagtattcccaacagctcttcgtgaatcacaagtagcagaagaggaggagtggctacacaaacaagctgaggcacgaagagcaatgaatactgacatagctgaactttgcgatttaaaagaagaagaaaagaacccagaatggttgaaggataaaggaaacaaattgtttgcaacggaaaactatttggcagctatcaatgcatataatttagccataagactaaataataagatgccactattgtatttgaaccgggctgcttgccacctaaaactaaaaaacttacacaaggctattgaagattcttctaaggcactggaattattgatgccacctgttacagacaatgctaatgcaagaatgaaggcacatgtacgacgtggaacagcattctgtcaactagaattgtatgtagaaggcctacaggattatgaagcggcacttaagattgatccatccaacaaaattgtacaaattgatgctgagaagattcggaatgtaattcaaggaacagaactaaaatcttaatgactattagaagtaactaagtattgttataagttttttaaaaacaactggaggcatctttgtacatattatggccagttgtacagaatcgctttctgtttagtactttagttctgttgagggcaaaatattataaatctatagaaaataaactgtttgacttgaatcatttctgaataagtaaatctaaataagaatctattttaattccttatttcttcatattaatacatatgtatacttttttgtgttactgaattaagcttgcccttgtaacaaaatatgttttggtatagttaccaggacacttactgattaatttttaacaaggtagaattttaaaataaaagatttataaataa

SEQ ID NO: 128693 - DNA, 1993 bp, Homo sapiens
  Payload ID: 5185
  Gene Symbol: DYX1C1
  Gene Name: dyslexia susceptibility 1 candidate 1
  Uniprot ID: Q8WXU2
  ENST ID: ENST00000321149
  CDS Start-End: 369-1631
tcctctcctattatgcaaacccacaccatggatccagcagactactctggccccagcatgctgctccttgggatgatgggagaagggggaaacctgtgttttctcttggttttagggtatgggtctacttctttgaacattcgctcagatcgtaaggtaaccccaagaatcggcatcactctctggtctgggcgcctggatagtcacgcatggagtccgcgaggtgctggcgccggagcacgctgggaacgccgggctcccggccggcctgacccggaagggctggcgcatggtaaccccagcttccctagcaaccaagcaggcgcaagaagcaaccagccgcgctatccgctcccgttgctaccggaatgcctcttcaggttagcgattacagctggcagcagacgaagactgcggtctttctgtctctgcccctcaaaggcgtgtgcgtcagagacacggacgtgttctgcacggaaaactatctgaaggtcaactttcctccatttttatttgaggcatttctttatgctcccatagacgatgagagcagcaaagcaaagattgggaatgacaccattgtcttcaccttgtataaaaaagaagcggccatgtgggagaccctttctgtgacgggtgttgacaaagagatgatgcaaagaattagagaaaaatctattttacaagcacaagagagagcaaaagaagctacagaagcaaaagctgcagcaaagcgggaagatcaaaaatacgcactaagtgtcatgatgaagattgaagaagaagagaggaaaaaaatagaagatatgaaagaaaatgaacggataaaagccactaaagcattggaagcctggaaagaatatcaaagaaaagctgaggagcaaaaaaaaattcagagagaagagaaattatgtcaaaaagaaaagcaaattaaagaagaaagaaaaaaaataaaatataagagtcttactagaaatttggcatctagaaatcttgctccaaaagggagaaattcagaaaatatatttactgagaagttaaaggaagacagtattcctgctcctcgctctgttggcagtattaaaatcaactttacccctcgagtattcccaacagctcttcgtgaatcacaagtagcagaagaggaggagtggctacacaaacaagctgaggcacgaagagcaatgaatactgacatagctgaactttgcgatttaaaagaagaagaaaagaacccagaatggttgaaggataaaggaaacaaattgtttgcaacggaaaactatttggcagctatcaatgcatataatttagccataagactaaataataagatgccactattgtatttgaaccgggctgcttgccacctaaaactaaaaaacttacacaaggctattgaagattcttctaaggcactggaattattgatgccacctgttacagacaatgctaatgcaagaatgaaggcacatgtacgacgtggaacagcattctgtcaactagaattgtatgtagaaggcctacaggattatgaagcggcacttaagattgatccatccaacaaaattgtacaaattgatgctgagaagattcggaatgtaattcaaggaacagaactaaaatcttaatgactattagaagtaactaagtattgttataagttttttaaaaacaactggaggcatctttgtacatattatggccagttgtacagaatcgctttctgtttagtactttagttctgttgagggcaaaatattataaatctatagaaaataaactgtttgacttgaatcatttctgaataagtaaatctaaataagaatctattttaattccttatttcttcatattaatacatatgtatacttttttgtgttactgaattaagcttgcccttgtaacaaaatatgttttggtatagttaccaggacacttactgattaatttttaacaaggtagaattttaaaataaaagatttataaataa

SEQ ID NO: 128694 - DNA, 1567 bp, Homo sapiens
  Payload ID: 5185
  Gene Symbol: DYX1C1
  Gene Name: dyslexia susceptibility 1 candidate 1
  Uniprot ID: Q8WXU2
  ENST ID: ENST00000457155
  CDS Start-End: 49-1179
aggcgcaagaagcaaccagccgcgctatccgctcccgttgctaccggaatgcctcttcaggttagcgattacagctggcagcagacgaagactgcggtctttctgtctctgcccctcaaaggcgtgtgcgtcagagacacggacgtgttctgcacggaaaactatctgaaggtcaactttcctccatttttatttgaggcatttctttatgctcccatagacgatgagagcagcaaagcaaagattgggaatgacaccattgtcttcaccttgtataaaaaagaagcggccatgtgggagaccctttctgtgacgggtgttgacaaagagatgatgcaaagaattagagaaaaatctattttacaagcacaagagagagcaaaagaagctacagaagcaaaagctgcagcaaagcgggaagatcaaaaatacgcactaagtgtcatgatgaagattgaagaagaagagaggaaaaaaatagaagatatgaaagaaaatgaacggataaaagccactaaagcattggaagcctggaaagaatatcaaagaaaagctgaggagcaaaaaaaaattcagagagaagagaaattatgtcaaaaagaaaagcaaattaaagaagaaagaaaaaaaataaaatataagagtcttactagaaatttggcatctagaaatcttgctccaaaagggagaaattcagaaaatatatttactgagaagttaaaggaagacagtattcctgctcctcgctctgttggcagtattaaaatcaactttacccctcgagtattcccaacagctcttcgtgaatcacaagtagcagaagaggaggagtggctacacaaacaagctgaggcacgaagagcaatgaatactgacatagctgaactttgcgatttaaaagaagaagaaaagaacccagaatggttgaaggataaaggaaacaaattgtttgcaacggaaaactatttggcagctatcaatgcatataatttagccataagactaaataataagatgccactattgtatttgaaccgggctgcttgccacctaaaactaaaaaacttacacaaggctattgaagattcttctaaggcctacaggattatgaagcggcacttaagattgatccatccaacaaaattgtacaaattgatgctgagaagattcggaatgtaattcaaggaacagaactaaaatcttaatgactattagaagtaactaagtattgttataagttttttaaaaacaactggaggcatctttgtacatattatggccagttgtacagaatcgctttctgtttagtactttagttctgttgagggcaaaatattataaatctatagaaaataaactgtttgacttgaatcatttctgaataagtaaatctaaataagaatctattttaattccttatttcttcatattaatacatatgtatacttttttgtgttactgaattaagcttgcccttgtaacaaaatatgttttggtatagttaccaggacacttactgattaatttttaacaaggtagaattttaaaataaaagatttataaataa

SEQ ID NO: 128695 - DNA, 1445 bp, Homo sapiens
  Payload ID: 5185
  Gene Symbol: DYX1C1
  Gene Name: dyslexia susceptibility 1 candidate 1
  Uniprot ID: Q8WXU2
  ENST ID: ENST00000448430
  CDS Start-End: 20-1165
cgctcccgttgctaccggaatgcctcttcaggttagcgattacagctggcagcagacgaagactgcggtctttctgtctctgcccctcaaaggcgtgtgcgtcagagacacggacgtgttctgcacggaaaactatctgaaggtcaactttcctccatttttatttgaggcatttctttatgctcccatagacgatgagagcagcaaagcaaagattgggaatgacaccattgtcttcaccttgtataaaaaagaagcggccatgtgggagaccctttctgtgacgggtgttgacaaagagatgatgcaaagaattagagaaaaatctattttacaagcacaagagagagcaaaagaagctacagaagcaaaagctgcagcaaagcgggaagatcaaaaatacgcactaagtgtcatgatgaagattgaagaagaagagaggaaaaaaatagaagatatgaaagaaaatgaacggataaaagccactaaagcattggaagcctggaaagaatatcaaagaaaagctgaggagcaaaaaaaaattcagagagaagagaaattatgtcaaaaagaaaagcaaattaaagaagaaagaaaaaaaataaaatataagagtcttactagaaatttggcatctagaaatcttgctccaaaagggagaaattcagaaaatatatttactgagaagttaaaggaagacagtattcctgctcctcgctctgttggcagtattaaaatcaactttacccctcgagtattcccaacagctcttcgtgaatcacaagtagcagaagaggaggagtggctacacaaacaagctgaggcacgaagagcaatgaatactgacatagctgaactttgcgatttaaaagaagaagaaaagaacccagaatggttgaaggataaaggaaacaaattgtttgcaacggaaaactatttggcagctatcaatgcatataatttagccataagactaaataataagatgccactattgtatttgaaccgggctgcttgccacctaaaactaaaaaacttacacaaggctattgaagattcttctaaggaattctgttctcttgagggcattgaatgtcaggcctctgagcccaagctaagccatcatatccctagtgacctgcacgtatacatccagatggcctgaagcaagtgaagaatcacaaaagaagtgaaaatggccggttcctgccttaactgatgacattaccttgtgaaattccttctcctggctcagaacctcccccactgagcaccttgtgacccctgcccctgcccgccacagaataaccccctttgactgtaattttccattacctacccaaatcctataaaacggccccacccctatctcccttcgctgactgtcttttcggactcagcccgcctccacccaggtgattaaaaagctttattgctcacacaaa

SEQ ID NO: 128696 - DNA, 1299 bp, Homo sapiens
  Payload ID: 5185
  Gene Symbol: DYX1C1
  Gene Name: dyslexia susceptibility 1 candidate 1
  ENST ID: ENST00000524160
  CDS Start-End: 13-453
gttgctaccggaatgcctcttcaggttagcgattacagctggcagcagacgaagactgcggtctttctgtctctgcccctcaaaggcgtgtgcgtcagagacacggacgtgttctgcacggaaaactatctgaaggtcaactttcctccatttttatttgaggcatttctttatgctcccatagacgatgagagcagcaaagcaaagattgggaatgacaccattgtcttcaccttgtataaaaaagaagcggccatgtgggagaccctttctgtgacgggtgttgacaaagagatgatgcaaagaattagagaaaaatctattttacaagcacaagagagagcaaaagaagctacagaagcaaaagctgcagcaaagcgggaagatcaaaaatacgcactaagtgtcatgatgaagggagaaattcagaaaatatatttactgagaagttaaaggaagacagtattcctgctcctcgctctgttggcagtattaaaatcaactttacccctcgagtattcccaacagctcttcgtgaatcacaagtagcagaagaggaggagtggctacacaaacaagctgaggcacgaagagcaatgaatactgacatagctgaactttgcgatttaaaagaagaagaaaagaacccagaatggttgaaggataaaggaaacaaattgtttgcaacggaaaactatttggcagctatcaatgcatataatttagccataagactaaataataagatgccactattgtatttgaaccgggctgcttgccacctaaaactaaaaaacttacacaaggctattgaagattcttctaaggcactggaattattgatgccacctgttacagacaatgctaatgcaagaatgaaggcacatgtacgacgtggaacagcattctgtcaactagaattgtatgtagaaggtttacctcaatgtatgatcttccagaaacagttctgaaacctacaggtttcctcagcacaggggaaagctttataggtggaaggtggaggccctgtgacttgcgcagaaaagtaccactgtaatttacttttatgggcacctaagcaggttgcccagggcaacttgtagattttgttgttgttgttgttaatactatctccttcagtcactgagaactcttttttatttttttattttttgagatggagttttgctcttgttgcctaggctggagtgcagtggcgtgatcttggctcactgcaacctccgcctcccggattcaagcgattctcttgcctcagccacccgagtagctgggattata

SEQ ID NO: 128697 - DNA, 672 bp, Homo sapiens
  Payload ID: 5185
  Gene Symbol: DYX1C1
  Gene Name: dyslexia susceptibility 1 candidate 1
  ENST ID: ENST00000522437
  CDS Start-End: 41-256
gaagcaaccagccgcgctatccgctcccgttgctaccggaatgcctcttcaggttagcgattacagctggcagcagacgaagactgcggtctttctgtctctgcccctcaaaggcgtgtgcgtcagagacacggacgtgttctgcacggaaaactatctgaagacgatgagagcagcaaagcaaagattgggaatgacaccattgtcttcaccttgtataaaaaagaagcggccatgtgggagaccctttctgtgacgggtgtgagccccagactacctaaagagttttaaagaatcaggttcctgttttttgacctcttacttcctctgtgactcattgacaaagagatgatgcaaagaattagagaaaaatctattttacaagcacaagagagagcaaaagaagctacagaagcaaaagctgcagcaaagcgggaagatcaaaaatacgcactaagtgtcatgatgaagattgaagaagaagagaggaaaaaaatagaagatatgaaagaaaatgaacggataaaagccactaaagcattggaagcctggaaagaatatcaaagaaaagctgaggagcaaaaaaaaattcagagagaagagaaattatgtcaaaaagaaaagcaaattaaagaagaaagaaaaaaaataaaatataagagtcttactaga

SEQ ID NO: 128698 - DNA, 16742 bp, Homo sapiens
  Payload ID: 5186
  Gene Symbol: DST
  Gene Name: dystonin
  Uniprot ID: Q03001
  ENST ID: ENST00000244364
  CDS Start-End: 209-15724
atggctttaggctagattcttttgaatagttatcagcatattatttgctgtgtgttgcatatgcatgttgaagcatatttaaggagccactaaaagctgtaatattcagctgccacttttcaccgttagaagtagagctttttccagacctcctaccttttagtctactttgaaaggtgaaagaaagaacatcgtttcaggaataaaaatgcacagtagtagttatagttaccgtagcagtgattctgtgtttagtaacactaccagcactcgaaccagtcttgattcaaatgaaaatcttctcttggttcattgtggtccaacactgatcaactcttgcattagcttcggcagtgaatcctttgatggacacaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaagaaagaacatgttgaaaaagccaaagaattgcaaaaatgggtatcaaatatcagcaagacattgaaagatgcagagaaggctggaaaacctcccttctctaagcaaaagatttccagtgaggaaatatcaaccaagaaggaacaattatcggaagcacttcaaactatacagctttttttggcaaaacatggagacaaaatgacagatgaagaaagaaatgaattggaaaaacaagtgaaaactcttcaggaaagttataatttattattcagtgaatctctgaaacagctacaagaatcacaaacctcaggagatgtaaaggtagaggagaagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatcttgcagcaagagagacggtggcaaggttgatacttctgcaacccacagagaagtgcagcgcaagttggatcatgctactgatcggttcaggtctctctactctaagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggctttgcaaggacagatatcaagtcagcaggttgctgtagagaaactgaagaaaacggctgaagtgcttttagatgccaggggatctttacttccagccaagaatgatatccagaaaacacttgatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaaggtcaagtgcctttaaactctactgctcttcaggatattatcagtaaaaacattatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggaatcaacttctgaatttttagaacacaagaaacatcttgaagttttgcatagtctcttgaaggagatatccagccatggcttaccaagtgataaggctttggtccttgaaaaaacaaataatttgtcaaagaaattcaaggaaatggaggataccatcaaagaaaaaaaagaagctgtaacttcttgtcaagaacagttggatgctttccaagttcttgttaaatcattgaagtcatggataaaagaaacaacaaaaaaagttcccattgtacagccttcttttggtgcagaggatttaggaaaatctttggaagacactaagaaattacaagaaaagtggagtttaaaaacaccagagattcagaaagtaaacaacagtgggatctcactatgtaacttaataagtgctgtgaccacccctgcaaaggcaatagcagcagttaaatcaggtggagcagtattaaatggtgaaggaacagccacaaatactgaggaattttgggcaaataaaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataagtcgtttgaggcagaactgaagcagaatgtaaacaaagtacaggagttgaaagacaaattgacagagctgttggaggagaacccagatactcctgaggcccccagatggaaacagatgttgacagaaatagattctaagtggcaagaactcaatcaattaacaattgatagacaacaaaaactggaagaatcctccaataatctaacccagttccagactgtagaggcccaattgaaacagtggcttgtggaaaaagaacttatggtcagtgttcttgggcccttgtcaattgacccaaatatgctaaacacacaaaggcagcaggtgcagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaacagaaaaaaaattgatgtctctgggtgacatcaggcttgagcaagaccagacttctgctcagcttcaagttcaaaagacattcaccatggagattttgagacacaaggatattattgatgaccttgttaaatctgggcataaaatcatgaccgcatgcagtgaagaggaaaagcaatcaatgaagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcggcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcatgggattctctaaataaagcttggaaagaccggattgacaaacttgaggaggcaatgcaggctgccgttcagtaccaggatggactgcaggcggtatttgactgggtagatattgcaggtggtaaattagcttcaatgtctccaattggaacagatctcgaaactgtcaagcagcagattgaagagctaaagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtgctccaaaatgatgtattagcccatcagtccacagtggaagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaa

SEQ ID NO: 128699 - DNA, 17756 bp, Homo sapiens
  Payload ID: 5186
  Gene Symbol: DST
  Gene Name: dystonin
  ENST ID: ENST00000312431
  CDS Start-End: 127-16740
attgttgggccagtcatttgtgagctggtggccggaccacaggccacacacttcttccgtgcaaatcttcatgtattgaaactgcctgtgtattgtttttacgattggagacttggccaagaaaagatgagttccgggaacgcgtcctatcgctgctctatgtcttcctctgcggatttttccgatgaggatgatttcagccagaaatctggctccgcatccccagctccgggagacaccttaccctggaatttgcctaaacatgagagatcgaaaagaaagattcaagggggctcagtgctggaccctgccgagagggcagtgcttcggatagcagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgtctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaagaaagaacatgttgaaaaagccaaagaattgcaaaaatgggtatcaaatatcagcaagacattgaaagatgcagagaaggctggaaaacctcccttctctaagcaaaagatttccagtgaggaaatatcaaccaagaaggaacaattatcggaagcacttcaaactatacagctttttttggcaaaacatggagacaaaatgacagatgaagaaagaaatgaattggaaaaacaagtgaaaactcttcaggaaagttataatttattattcagtgaatctctgaaacagctacaagaatcacaaacctcaggagatgtaaaggtagaggagaagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatcttgcagcaagagagacggtggcaaggttgatacttctgcaacccacagagaagtgcagcgcaagttggatcatgctactgatcggttcaggtctctctactctaagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggctttgcaaggacagatatcaagtcagcaggttgctgtagagaaactgaagaaaacggctgaagtgcttttagatgccaggggatctttacttccagccaagaatgatatccagaaaacacttgatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaaggtcaagtgcctttaaactctactgctcttcaggatattatcagtaaaaacattatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggaatcaacttctgaatttttagaacacaagaaacatcttgaagttttgcatagtctcttgaaggagatatccagccatggcttaccaagtgataaggctttggtccttgaaaaaacaaataatttgtcaaagaaattcaaggaaatggaggataccatcaaagaaaaaaaagaagctgtaacttcttgtcaagaacagttggatgctttccaagttcttgttaaatcattgaagtcatggataaaagaaacaacaaaaaaagttcccattgtacagccttcttttggtgcagaggatttaggaaaatctttggaagacactaagaaattacaagaaaagtggagtttaaaaacaccagagattcagaaagtaaacaacagtgggatctcactatgtaacttaataagtgctgtgaccacccctgcaaaggcaatagcagcagttaaatcaggtggagcagtattaaatggtgaaggaacagccacaaatactgaggaattttgggcaaataaaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataagtcgtttgaggcagaactgaagcagaatgtaaacaaagtacaggagttgaaagacaaattgacagagctgttggaggagaacccagatactcctgaggcccccagatggaaacagatgttgacagaaatagattctaagtggcaagaactcaatcaattaacaattgatagacaacaaaaactggaagaatcctccaataatctaacccagttccagactgtagaggcccaattgaaacagtggcttgtggaaaaagaacttatggtcagtgttcttgggcccttgtcaattgacccaaatatgctaaacacacaaaggcagcaggtgcagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaacagaaaaaaaattgatgtctctgggtgacatcaggcttgagcaagaccagacttctgctcagcttcaagttcaaaagacattcaccatggagattttgagacacaaggatattattgatgaccttgttaaatctgggcataaaatcatgaccgcatgcagtgaagaggaaaagcaatcaatgaagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcggcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcatgggattctctaaataaagcttggaaagaccggattgacaaacttgaggaggcaatgcaggctgccgttcagtaccaggatggactgcaggcggtatttgactgggtagatattgcaggtggtaaattagcttcaatgtctccaattggaacagatctcgaaactgtcaagcagcagattgaagagctaaagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtgctccaaaatgatgtattagcccatcagtccacagtggaagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatgg

SEQ ID NO: 128700 - DNA, 22431 bp, Homo sapiens
  Payload ID: 5186
  Gene Symbol: DST
  Gene Name: dystonin
  ENST ID: ENST00000361203
  CDS Start-End: 9-22394
acttcggcatggcgggttacctctcccctgctgcttacctgtacgtggaggagcaggagtatctccaggcctacgaggatgtcctggagaggtacaaagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgtctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaagaaagaacatgttgaaaaagccaaagaattgcaaaaatgggtatcaaatatcagcaagacattgaaagatgcagagaaggctggaaaacctcccttctctaagcaaaagatttccagtgaggaaatatcaaccaagaaggaacaattatcggaagcacttcaaactatacagctttttttggcaaaacatggagacaaaatgacagatgaagaaagaaatgaattggaaaaacaagtgaaaactcttcaggaaagttataatttattattcagtgaatctctgaaacagctacaagaatcacaaacctcaggagatgtaaaggtagaggagaagctggataaagtgattgcaggcaccattgatcagacaactggagaagtcctttcagtctttcaagcagttttaagaggcctcattgactatgacacaggaattaggttgcttgagacacagctaatgatttctggtctaatttcaccagaattaagaaagtgctttgaccttaaagatgccaaaagtcatggccttattgatgaacaaattctgtgccaactcaaagaactaagtaaagctaaggagattatttctgctgcgtcacctaccacaattccagtactggatgctctagctcaaagcatgataacagaatccatggccatcaaagttcttgagatactgctttctacaggctctctggttattccagccacaggagaacagttgaccctacagaaggctttccaacagaacttggtttcctcagcattattttctaaagttctggaaaggcaaaatatgtgcaaagatcttattgacccctgcacctctgagaaggtttctttaatagatatggtacaaagaagtactttacaggaaaacacagggatgtggcttctacctgtgagaccacaagaaggaggtagaataacattaaaatgtggaagaaacataagcattttaagagcagctcatgaaggtctcatagaccgtgaaaccatgtttaggttgttaagtgcacagcttctttctggaggtctgatcaattccaactctggccaaagaatgactgttgaagaagctgtcagagaaggggtgattgacagggacactgctagcagtatcctcacatatcaggttcaaactggtggaatcatccagtcaaaccctgccaagcgtttaactgtagacgaagcagtacagtgtgatttaataacttccagcagtgctcttctggtcctggaagctcagcgaggctatgttggactcatttggccccattctggtgaaatatttcccacatcatcttccttgcagcaagaattgattacaaatgaattggcctacaaaatcctgaatggcagacaaaaaatagctgctctttatattccagaaagttctcaagtcattggtttggatgctgctaaacagctaggaattatagacaacaacacagcatcaattttaaaaaatataacactgcctgataaaatgccagatttaggagatttagaagcttgtaaaaatgccagaagatggctctctttttgtaaatttcaaccctccacagttcatgattacagacaagaagaggatgtttttgatggagaagaacctgtcactactcagacctcagaagaaactaaaaaattatttctatcttatttaatgataaatagctatatggatgcaaacacagggcaaaggcttttgctgtacgatggagacttggatgaggctgttggcatgctactggaaggctgtcatgcagaatttgatggaaacacagccataaaagaatgtctcgatgtcttaagctcatctggtgtatttcttaataatgcttcaggtagagaaaaggatgaatgtacagctacaccaagtagtttcaataaatgtcactgtggagaacctgaacatgaagagactcctgaaaatagaaagtgtgctatagatgaagaatttaatgaaatgagaaatactgttatcaatagtgaattttctcagtcaggaaaactggcaagtacaatatcaattgatcctaaagttaacagttcacccagtgtgtgtgttcccagtctcatatcatatttaacacagactgaacttgcagacattagcatgcttagaagtgactctgaaaacatacttacaaactatgaaaatcaaagccgagtggaaacaaatgaacgtgcaaatgaatgtagtcattctaaaaacattcaaaactttccaagtgatttaatagaaaatcctattatgaaatcaaaaatgagtaaattctgtggtgtgaatgaaacagagaatgaagataatacaaacagggattcacctatctttgactattcccccaggctaagtgccttgttaagtcatgataaattgatgcacagtcagggaagttttaatgatacacacaccccagagagcaatggaaataagtgtgaagccccagccttatcattcagtgacaaaaccatgttgtcaggtcaaagaataggagaaaaatttcaagaccagtttctgggaattgcagctattaacatcagtttaccaggagagcagtatggacagaaatctttaaatatgatttctagtaatcctcaagtacaatatcacaatgataaatacatttcaaatacttctggtgaggatgaaaaaacacatccaggttttcagcagatgcctgaagacaaggaagatgagtctgaaatagaagagtattcctgtgctgtgactccagggggtgatactgataatgccattgtgtctcttacttgtgctacaccattgcttgatgaaaccatcagtgctagtgactatgaaacgtcactgctgaatgatcagcagaataacacaggaacagacactgatagtgatgatgatttttatgatactcccttgtttgaagatgatgaccatgattctttgcttcttgatggtgatgatcgtgattgcctgcaccctgaggactacgacacactgcaagaggaaaatgatgagacggcttctcctgctgatgttttttatgatgtctcaaaagagaatgaaaattccatggttccccagggggcaccagttggtagcttaagtgtgaagaacaaagcacattgtcttcaggatttccttatggatgttgagaaagatgaattagattctggtgaaaaaatacatttaaatcctgttggctcagataaggtgaatggacagtcactggaaactggatcagaaagggaatgcacaaatatccttgaaggtgatgaatctgactcattgactgattatgatattgtaggaggaaaagagagcttcactgcatcattaaaatttgatgacagtggcagttggagaggaagaaaggaagagtatgtaactggacaggaatttcactccgatactgatcatttagattctatgcaaagtgaagaaagttatggggattatatatatgacagtaatgatcaggatgacgatgatgatgatggcattgatgaagaaggaggaggtataagagatgagaatggaaagcccaggtgccaaaatgtggctgaagatatggatatccagttgtgtgcctctattttaaatgaaaacagtgatgaaaatgaaaatattaatacaatgattcttctggataaaatgcacagttgtagctctttagaaaaacagcaaagggtaaatgttgtacagctagcatcacctagtgaaaataacttagttactgaaaaaagcaaccttccagaatatacaactgagattgctggaaaaagcaaagaaaatctgttgaaccatgagatggtacttaaggatgtattgccgcctatcattaaagacactgaatctgaaaaaacttttggccctgcaagtatttcacatgataataataatatcagttcaacttctgaattaggtactgatctagcaaacacaaaggttaagttgattcaagggtcagaattgccagaattgactgattctgtgaaaggtaaagatgaatattttaagaatatgacaccaaaagttgactcatctcttgatcacatcatttgtactgagcctgatttaataggaaaacctgctgaggaaagccatttgtcattgatagcctctgtaactgacaaagatcctcaaggaaatggaagcgatctcattaaagggagagatggcaaaagtgatattctaatagaagatgaaacatcaattcagaaaatgtacttgggtgaaggagaagtgcttgtagaaggtctagtagaagaagaaaataggcatctcaaacttttgcctggtaaaaatacaagggatagtttcaagttaattaatagtcagtttccatttccacaaatcacaaacaatgaagaacttaatcagaaaggaagccttaaaaaagcaactgtaactcttaaagatgaaccaaataatctacaaataatagttagtaaaagtcctgttcagtttgagaatcttgaagaaatttttgacacatcagtttccaaagagattagtgatgacattacttcagacattacatcgtgggaagggaatacacattttgaggagtcattcactgatggacctgagaaagagcttgatctgtttacttacttaaaacattgtgctaaaaatataaaagcaaaagatgtagccaaaccaaatgaagatgtcccaagccatgttttaataactgcccctcccatgaaagaacatttacaattaggagttaataatacaaaagagaagtccactagtacccaaaaagactcacctcttaatgacatgatccaaagcaatgatctttgtagtaaagaaagcatctcaggaggaggaacagaaatttctcagttcacaccagaaagtattgaagccacactttcaatattatctcgtaaacatgtagaagatgttgggaaaaatgattttctgcagtcggagcggtgtgcaaatggattaggaaatgataactccagtaacactttaaatactgactattcattcttagaaattaataataagaaagaaagaattgagcaacagctaccaaaagaacaagccttgtctccaagatcccaagaaaaggaggttcagattcctgaattgtctcaggtatttgtggaggatgtaaaggatatcttaaaaagcaggttgaaagaaggtcatatgaaccctcaagaggttgaagaaccttcagcctgtgcagacactaaaattttaattcaaaatttaattaaaaggattaccacatcacagttggtaaatgaggcatctactgtgcccagcgactctcaaatgagtgactcttctggagtttcccccatgactaactcatcagaactaaagccagaaagtagagatgatcctttctgtattggaaatcttaagtctgagcttctccttaatatattgaagcaagatcaacatagccaaaaaattacaggagtatttgaattgatgagagaattaactcatatggagtatgacctagagaaaagaggcattacgtctaaagtacttccactgcagcttgaaaatattttctacaaactgcttgctgatggatattcagagaaaatagaacatgttggagactttaatcaaaaagcatgttctacatctgagatgatggaagaaaagccacatattcttggtgatattaaaagcaaagaaggaaactactattctcctaatttagaaactgtaaaagaaattggactagaaagctctactgtgtgggcatcaacattgccaagagatgagaagctcaaggatctgtgtaatgatttcccaagccatttggaatgtacttcagggtctaaagagatggcttctggagatagctcaaccgaacaattttccagtgaattacagcagtgtttacagcacactgaaaaaatgcatgagtatttgacattgcttcaagatatgaaaccccccttagacaaccaggaatctctggataacaacttggaagctttgaagaatcaacttagacagttggagacatttgaattgggattagctccaattgctgttattttaagaaaagatatgaagttggcagaagagtttttaaagtctcttcccagtgactttcccagaggccatgttgaagaattgagtattagccaccagagtttgaagaccgccttctcttccctcagcaacgtgtcttcagaaagaacgaaacagatcatgcttgcgatcgactctgaaatgtctaaactagcagtttcccatgaagaatttctgcataaacttaagtcattctcagattgggtatcagagaagagcaaatctgtgaaggatattgagattgtgaatgttcaagattctgagtatgtaaagaaacgtttggagtttctcaagaatgtattaaaagaccttggacataccaaaatgcagctggagactactgcctttgatgtgcagttcttcatttctgaatatgcacaggatctgtctcccaaccaaagcaaacaactgctgaggctcttaaatacaactcagaagtgttttcttgatgtacaggagtcagtaactacccaggtggaacgtttagagactcagttacatctagaacaagatcttgatgatcagaagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatcttgcagcaagagagacggtggcaaggttgatacttctgcaacccacagagaagtgcagcgcaagttggatcatgctactgatcggttcaggtctctctactctaagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggctttgcaaggacagatatcaagtcagcaggttgctgtagagaaactgaagaaaacggctgaagtgcttttagatgccaggggatctttacttccagccaagaatgatatccagaaaacacttgatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaaggtcaagtgcctttaaactctactgctcttcaggatattatcagtaaaaacattatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggaatcaacttctgaatttttagaacacaagaaacatcttgaagttttgcatagtctcttgaaggagatatccagccatggcttaccaagtgataaggctttggtccttgaaaaaacaaataatttgtcaaagaaattcaaggaaatggaggataccatcaaagaaaaaaaagaagctgtaacttcttgtcaagaacagttggatgctttccaagttcttgttaaatcattgaagtcatggataaaagaaacaacaaaaaaagttcccattgtacagccttcttttggtgcagaggatttaggaaaatctttggaagacactaagaaattacaagaaaagtggagtttaaaaacaccagagattcagaaagtaaacaacagtgggatctcactatgtaacttaataagtgctgtgaccacccctgcaaaggcaatagcagcagttaaatcaggtggagcagtattaaatggtgaaggaacagccacaaatactgaggaattttgggcaaataaaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataagtcgtttgaggcagaactgaagcagaatgtaaacaaagtacaggagttgaaagacaaattgacagagctgttggaggagaacccagatactcctgaggcccccagatggaaacagatgttgacagaaatagattctaagtggcaagaactcaatcaattaacaattgatagacaacaaaaactggaagaatcctccaataatctaacccagttccagactgtagaggcccaattgaaacagtggcttgtggaaaaagaacttatggtcagtgttcttgggcccttgtcaattgacccaaatatgctaaacacacaaaggcagcaggtgcagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaacagaaaaaaaattgatgtctctgggtgacatcaggcttgagcaagaccagacttctgctcagcttcaagttcaaaagacattcaccatggagattttgagacacaaggatattattgatgaccttgttaaatctgggcataaaatcatgaccgcatgcagtgaagaggaaaagcaatcaatgaagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcggcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcatgggattctctaaataaagcttggaaagaccggattgacaaacttgaggaggcaatgcaggctgccgttcagtaccaggatggactgcaggcggtatttgactgggtagatattgcaggtggtaaattagcttcaatgtctccaattggaacagatctcgaaactgtcaagcagcagattgaagagctaaagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtgctccaaaatgatgtattagcccatcagtccacagtggaagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggttcatcatcatgggagtaaaatgttacgttcggaatcaaactcttcaattactactactcagcctactatagccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcattt

SEQ ID NO: 128701 - DNA, 18085 bp, Homo sapiens
  Payload ID: 5186
  Gene Symbol: DST
  Gene Name: dystonin
  ENST ID: ENST00000370754
  CDS Start-End: 42-17069
ctccagccccgccgtcgagtcgccctcgcctcgcccgcaccatgatcgccgcggctttcctcgtcttgctgagaccctacagcatccaatgtgccctcttcctcttgttgcttctgctgggcaccatcgccaccatcgtcttcttctgctgctggcaccgcaagctccagaaagggaggcatccgatgaaatcggtcttctcgggtcgttcaagaagccgagatgctgttttgagatcgcaccactttcgttctgagggattcagagcaagccctcggcatcttagaagacgagttgcagcggccgcagctgcccgtctggaagaagtgaagcccgtggtggaagttcaccatcagagtgagcaagaaacttcagtgaggaaacgaagaatcaagaagagcagccgagtccagccagaattttatcactctgttcaaggtgcttcaatcaggaggcctagttccgggaacgcgtcctatcgctgctctatgtcttcctctgcggatttttccgatgaggatgatttcagccagaaatctggctccgcatccccagctccgggagacaccttaccctggaatttgcctaaacatgagagatcgaaaagaaagattcaagggggctcagtgctggaccctgccgagagggcagtgcttcggatagcagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgtctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaagaaagaacatgttgaaaaagccaaagaattgcaaaaatgggtatcaaatatcagcaagacattgaaagatgcagagaaggctggaaaacctcccttctctaagcaaaagatttccagtgaggaaatatcaaccaagaaggaacaattatcggaagcacttcaaactatacagctttttttggcaaaacatggagacaaaatgacagatgaagaaagaaatgaattggaaaaacaagtgaaaactcttcaggaaagttataatttattattcagtgaatctctgaaacagctacaagaatcacaaacctcaggagatgtaaaggtagaggagaagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatcttgcagcaagagagacggtggcaaggttgatacttctgcaacccacagagaagtgcagcgcaagttggatcatgctactgatcggttcaggtctctctactctaagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggctttgcaaggacagatatcaagtcagcaggttgctgtagagaaactgaagaaaacggctgaagtgcttttagatgccaggggatctttacttccagccaagaatgatatccagaaaacacttgatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaaggtcaagtgcctttaaactctactgctcttcaggatattatcagtaaaaacattatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggaatcaacttctgaatttttagaacacaagaaacatcttgaagttttgcatagtctcttgaaggagatatccagccatggcttaccaagtgataaggctttggtccttgaaaaaacaaataatttgtcaaagaaattcaaggaaatggaggataccatcaaagaaaaaaaagaagctgtaacttcttgtcaagaacagttggatgctttccaagttcttgttaaatcattgaagtcatggataaaagaaacaacaaaaaaagttcccattgtacagccttcttttggtgcagaggatttaggaaaatctttggaagacactaagaaattacaagaaaagtggagtttaaaaacaccagagattcagaaagtaaacaacagtgggatctcactatgtaacttaataagtgctgtgaccacccctgcaaaggcaatagcagcagttaaatcaggtggagcagtattaaatggtgaaggaacagccacaaatactgaggaattttgggcaaataaaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataagtcgtttgaggcagaactgaagcagaatgtaaacaaagtacaggagttgaaagacaaattgacagagctgttggaggagaacccagatactcctgaggcccccagatggaaacagatgttgacagaaatagattctaagtggcaagaactcaatcaattaacaattgatagacaacaaaaactggaagaatcctccaataatctaacccagttccagactgtagaggcccaattgaaacagtggcttgtggaaaaagaacttatggtcagtgttcttgggcccttgtcaattgacccaaatatgctaaacacacaaaggcagcaggtgcagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaacagaaaaaaaattgatgtctctgggtgacatcaggcttgagcaagaccagacttctgctcagcttcaagttcaaaagacattcaccatggagattttgagacacaaggatattattgatgaccttgttaaatctgggcataaaatcatgaccgcatgcagtgaagaggaaaagcaatcaatgaagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcggcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcatgggattctctaaataaagcttggaaagaccggattgacaaacttgaggaggcaatgcaggctgccgttcagtaccaggatggactgcaggcggtatttgactgggtagatattgcaggtggtaaattagcttcaatgtctccaattggaacagatctcgaaactgtcaagcagcagattgaagagctaaagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtgctccaaaatgatgtattagcccatcagtccacagtggaagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatgg

SEQ ID NO: 128702 - DNA, 8999 bp, Homo sapiens
  Payload ID: 5186
  Gene Symbol: DST
  Gene Name: dystonin
  Uniprot ID: Q03001
  ENST ID: ENST00000370765
  CDS Start-End: 109-8058
aatattcagctgccacttttcaccgttagaagtagagctttttccagacctcctaccttttagtctactttgaaaggtgaaagaaagaacatcgtttcaggaataaaaatgcacagtagtagttatagttaccgtagcagtgattctgtgtttagtaacactaccagcactcgaaccagtcttgattcaaatgaaaatcttctcttggttcattgtggtccaacactgatcaactcttgcattagcttcggcagtgaatcctttgatggacacaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagattaaaaggtgtaaggagacttctgaacatggggcatattcagatctgcttcagcgtcagaaggcaacagtgcttgagaatagcaaacttacaggaaagataagtgagttggaaagaatggtagctgaactaaagaaacaaaagtcccgagtagaggaagaacttccgaaggtcagggaggctgcagaaaatgaattgagaaagcagcagagaaatgtagaagatatctctctgcagaagataagggctgaaagtgaagccaagcagtaccgcagggaacttgaaaccattgtgagagagaaggaagccgctgaaagagaactggagcgggtgaggcagctcaccatagaggccgaggctaaaagagctgccgtggaagagaacctcctgaattttcgcaatcagttggaggaaaacacctttaccagacgaacactggaagatcatcttaaaagaaaagatttaagtctcaatgatttggagcaacaaaaaaataaattaatggaagaattaagaagaaagagagacaatgaggaagaactcttgaagctgataaagcagatggaaaaagaccttgcatttcagaaacaggtagcagagaaacagttgaaagaaaagcagaaaattgaattggaagcaagaagaaaaataactgaaattcagtatacatgtagagaaaatgcattgccagtgtgtccgatcacacaggctacatcatgcagggcagtaacgggtctccagcaagaacatgacaagcagaaagcagaagaactcaaacagcaggtagatgaactaacagctgccaatagaaaggctgaacaagacatgagagagctgacatatgaacttaatgccctccagcttgaaaaaacgtcatctgaggaaaaggctcgtttgctaaaagataaactagatgaaacaaataatacactcagatgccttaagttggagctggaaaggaaggatcaggcggagaaagggtattctcaacaactcagagagcttggtaggcaattgaatcaaaccacaggtaaagctgaagaagccatgcaagaagctagtgatctcaagaaaataaagcgcaattatcagttagaattagaatctcttaatcatgaaaaagggaaactacaaagagaagtagacagaatcacaagggcacatgctgtagctgagaagaatattcagcatttaaattcacaaattcattcttttcgagatgagaaagaattagaaagactacaaatctgccagagaaaatcagatcatctaaaagaacaatttgagaaaagccatgagcagttgcttcaaaatatcaaagctgaaaaagaaaataatgataaaatccaaaggctcaatgaagaattggagaaaagtaatgagtgtgcagagatgctaaaacaaaaagtagaggagcttactaggcagaataatgaaaccaaattaatgatgcagagaattcaggcagaatcagagaatatagttttagagaaacaaactatccagcaaagatgtgaagcactgaaaattcaggcagatggttttaaagatcagctacgcagcacaaatgaacacttgcataaacagacaaaaacagagcaggattttcaaagaaaaattaaatgcctagaagaagacctggcgaaaagtcaaaatttggtaagtgaatttaagcaaaagtgtgaccaacagaacattatcatccagaataccaagaaagaagttagaaatctgaatgcggaactgaatgcttccaaagaagagaagcgacgcggggagcagaaagttcagctacaacaagctcaggtgcaagagttaaataacaggttgaaaaaagtacaagacgaattacacttaaagaccatagaggagcagatgacccacagaaagatggttctgtttcaggaagaatctggtaaattcaaacaatcagcagaggagtttcggaagaagatggaaaaattaatggagtccaaagtcatcactgaaaatgatatttcaggcattaggcttgactttgtgtctcttcaacaagaaaactctagagcccaagaaaatgctaagctttgtgaaacaaacattaaagaacttgaaagacagcttcaacagtatcgtgaacaaatgcagcaagggcagcacatggaagcaaatcattaccaaaaatgtcagaaacttgaggatgagctgatagcccagaagcgtgaggttgaaaacctgaagcaaaaaatggaccaacagatcaaagagcatgaacatcaattagttttgctccagtgtgaaattcaaaaaaagagcacagccaaagactgtaccttcaaaccagattttgagatgacagtgaaggagtgccagcactctggagagctgtcctctagaaacactggacaccttcacccaacacccagatcccctctgttgagatggactcaagaaccacagccattggaagagaagtggcagcatcgggttgttgaacagatacccaaagaagtccaattccagccaccaggggctccactcgagaaagagaaaagccagcagtgttactctgagtacttttctcagacaagcaccgagttacagataacttttgatgagacaaaccccattacaagactgtctgaaattgagaagataagagaccaagccctgaacaattctagaccacctgttaggtatcaagataacgcatgtgaaatggaactggtgaaggttttgacacccttagagatagctaagaacaagcagtatgatatgcatacagaagtcacaacattaaaacaagaaaagaacccagttcccagtgctgaagaatggatgcttgaagggtgcagagcatctggtggactcaagaaaggggatttccttaagaagggcttagaaccagagaccttccagaactttgatggtgatcatgcatgttcagtcagggatgatgaatttaaattccaagggcttaggcacactgtgactgccaggcagttggtggaagctaagcttctggacatgagaacaattgagcagctgcgactcggtcttaagactgttgaagaagttcagaaaactcttaacaagtttctgacgaaagccacctcaattgcagggctttacctagaatctacaaaagaaaagatttcatttgcctcagcggccgagagaatcataatagacaaaatggtggctttggcatttttagaagctcaggctgcaacaggttttataattgatcccatttcaggtcagacatattctgttgaagatgcagttcttaaaggagttgttgaccccgaattcagaattaggcttcttgaggcagagaaggcagctgtgggatattcttattcttctaagacattgtcagtgtttcaagctatggaaaatagaatgcttgacagacaaaaaggtaaacatatcttggaagcccagattgccagtgggggtgtcattgaccctgtgagaggcattcgtgttcctccagaaattgctctgcagcaggggttgttgaataatgccatcttacagtttttacatgagccatccagcaacacaagagttttccctaatcccaataacaagcaagctctgtattactcagaattactgcgaatgtgtgtatttgatgtagagtcccaatgctttctgtttccatttggggagaggaacatttccaatctcaatgtcaagaaaacacatagaatttctgtagtagatactaaaacaggatcagaattgaccgtgtatgaggctttccagagaaacctgattgagaaaagtatatatcttgaactttcagggcagcaatatcagtggaaggaagctatgttttttgaatcctatgggcattcttctcatatgctgactgatactaaaacaggattacacttcaatattaatgaggctatagagcagggaacaattgacaaagccttggtcaaaaagtatcaggaaggcctcatcacacttacagaacttgctgattctttgctgagccggttagtccccaagaaagatttgcacagtcctgttgcagggtattggctgactgctagtggggaaaggatctctgtactaaaagcctcccgtagaaatttggttgatcggattactgccctccgatgccttgaagcccaagtcagtacagggggcataattgatcctcttactggcaaaaagtaccgggtggccgaagctttgcatagaggcctggttgatgaggggtttgcccagcagctgcgacagtgtgaattagtaatcacagggattggccatcccatcactaacaaaatgatgtcagtggtggaagctgtgaatgcaaatattataaataaggaaatgggaatccgatgtttggaatttcagtacttgacaggagggttgatagagccacaggttcactctcggttatcaatagaagaggctctccaagtaggtattatagatgtcctcattgccacaaaactcaaagatcaaaagtcatatgtcagaaatataatatgccctcagacaaaaagaaagttgacatataaagaagccttagaaaaagctgattttgatttccacacaggacttaaactgttagaagtatctgagcccctgatgacaggaatttctagcctctactattcttcctaatgggacatgtttaaataactgtgcaaggggtgatgcaggctggttcatgccactttttcagagtatgatgatatcggctacatatgcagtctgtgaattatgtaacatactctatttcttgagggctgcaaattgctaagtgctcaaaatagagtaagttttaaattgaaaattacataagatttaatgcccttcaaatggtttcatttagccttgagaatggttttttgaaacttggccacactaaaatgtttttttttttacgtagaatgtgggataaacttgatgaactccaagttcacagtgtcatttcttcagaactccccttcattgaatagtgatcatttattaaatgataaattgcactcgctgaaagagcacgtcatgaagcaccatggaatcaaagagaaagatataaattcgttcccacagccttcaagctgcagtgttttagattgcttcaaaaaatgaaaaagttttgcctttttctgtatatagtgaccttctttgcatattaaaatgtttaccacaatgtcccatttctagttaagtcttcgcacttgaaagctaacattatgaatattatgtgttggaggaggggaaggattttcttcattctgtgtattttccttacatgtacagtagacgttctctattctatcagccttctatggtacctttttgtcaggacaattaggattgtaatgctaatgcaaaggcagcaattcaaagatcttctagtgcctcatgaataaagttgagatttaaaatttgtaacattgatggaacagctgggaggttagaccaatcattaaggaatgtatgccatagctttctttgctaccataaacattttggaggtgcatctgctatgtgacatggtaaatatggttaagtgaatgaataaaatgttttagtaacctgtgtgtgatgaaaaaaaa

SEQ ID NO: 128703 - DNA, 17657 bp, Homo sapiens
  Payload ID: 5186
  Gene Symbol: DST
  Gene Name: dystonin
  ENST ID: ENST00000370788
  CDS Start-End: 521-16648
cggcggccaggaaatgccgcagatgcgccgcgcagcatccccggtgaaggcagcgcgccggtcctcccgcaccgctgccgcggcctcggcccggcccgaagcacgcgcctcgtgcagggccagcagagcggtcagcgcggccgcagagggtccgggcgcccgccggcccccgcccgccctcgccgcacgccccgctcctccgcttggcgtggcgctgctcgtcgccgcccctgggctcgctgagatttgccgctgctgaaacccgagagggactcgggctcccggagccgggcggcccaccatcggcctgcccggaggcctgggcgtttcctttgccggccctggcgccggcagccccctgcgcccccgctctgcgtcttcggcttccgtgcttctccccagcgtgctgctccttcctcttttccagttcccaaggctgtgtcttgctgactgcgatactgtccgggggttacgagggggagaggggaatttgtcagtcatcgcttagataaacttcggcatggcgggttacctctcccctgctgcttacctgtacgtggaggagcaggagtatctccaggcctacgaggatgtcctggagaggtacaaagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgtctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaagaaagaacatgttgaaaaagccaaagaattgcaaaaatgggtatcaaatatcagcaagacattgaaagatgcagagaaggctggaaaacctcccttctctaagcaaaagatttccagtgaggaaatatcaaccaagaaggaacaattatcggaagcacttcaaactatacagctttttttggcaaaacatggagacaaaatgacagatgaagaaagaaatgaattggaaaaacaagtgaaaactcttcaggaaagttataatttattattcagtgaatctctgaaacagctacaagaatcacaaacctcaggagatgtaaaggtagaggagaagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatcttgcagcaagagagacggtggcaaggttgatacttctgcaacccacagagaagtgcagcgcaagttggatcatgctactgatcggttcaggtctctctactctaagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggctttgcaaggacagatatcaagtcagcaggttgctgtagagaaactgaagaaaacggctgaagtgcttttagatgccaggggatctttacttccagccaagaatgatatccagaaaacacttgatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaaggtcaagtgcctttaaactctactgctcttcaggatattatcagtaaaaacattatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggaatcaacttctgaatttttagaacacaagaaacatcttgaagttttgcatagtctcttgaaggagatatccagccatggcttaccaagtgataaggctttggtccttgaaaaaacaaataatttgtcaaagaaattcaaggaaatggaggataccatcaaagaaaaaaaagaagctgtaacttcttgtcaagaacagttggatgctttccaagttcttgttaaatcattgaagtcatggataaaagaaacaacaaaaaaagttcccattgtacagccttcttttggtgcagaggatttaggaaaatctttggaagacactaagaaattacaagaaaagtggagtttaaaaacaccagagattcagaaagtaaacaacagtgggatctcactatgtaacttaataagtgctgtgaccacccctgcaaaggcaatagcagcagttaaatcaggtggagcagtattaaatggtgaaggaacagccacaaatactgaggaattttgggcaaataaaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataagtcgtttgaggcagaactgaagcagaatgtaaacaaagtacaggagttgaaagacaaattgacagagctgttggaggagaacccagatactcctgaggcccccagatggaaacagatgttgacagaaatagattctaagtggcaagaactcaatcaattaacaattgatagacaacaaaaactggaagaatcctccaataatctaacccagttccagactgtagaggcccaattgaaacagtggcttgtggaaaaagaacttatggtcagtgttcttgggcccttgtcaattgacccaaatatgctaaacacacaaaggcagcaggtgcagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaacagaaaaaaaattgatgtctctgggtgacatcaggcttgagcaagaccagacttctgctcagcttcaagttcaaaagacattcaccatggagattttgagacacaaggatattattgatgaccttgttaaatctgggcataaaatcatgaccgcatgcagtgaagaggaaaagcaatcaatgaagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcggcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcatgggattctctaaataaagcttggaaagaccggattgacaaacttgaggaggcaatgcaggctgccgttcagtaccaggatggactgcaggcggtatttgactgggtagatattgcaggtggtaaattagcttcaatgtctccaattggaacagatctcgaaactgtcaagcagcagattgaagagctaaagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtgctccaaaatgatgtattagcccatcagtccacagtggaagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggttcatcatcatgggagtaaaatgttacgttcggaatcaaactcttcaattactactactcagcctactatagccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaa

SEQ ID NO: 128704 - DNA, 2108 bp, Homo sapiens
  Payload ID: 5186
  Gene Symbol: DST
  Gene Name: dystonin
  ENST ID: ENST00000449297
  CDS Start-End: 42-2108
ctccagccccgccgtcgagtcgccctcgcctcgcccgcaccatgatcgccgcggctttcctcgtcttgctgagaccctacagcatccaatgtgccctcttcctcttgttgcttctgctgggcaccatcgccaccatcgtcttcttctgctgctggcaccgcaagctccagaaagggaggcatccgatgaaatcggtcttctcgggtcgttcaagaagccgagatgctgttttgagatcgcaccactttcgttctgagggattcagagcaagccctcggcatcttagaagacgagttgcagcggccgcagctgcccgtctggaagaagtgaagcccgtggtggaagttcaccatcagagtgagcaagaaacttcagtgaggaaacgaagaatcaagaagagcagccgagtccagccagaattttatcactctgttcaaggtgcttcaatcaggaggcctagttccgggaacgcgtcctatcgctgctctatgtcttcctctgcggatttttccgatgaggatgatttcagccagaaatctggctccgcatccccagctccgggagacaccttaccctggaatttgcctaaacatgagagatcgaaaagaaagattcaagggggctcagtgctggaccctgccgagagggcagtgcttcggatagcagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgtctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgca

SEQ ID NO: 128705 - DNA, 18030 bp, Homo sapiens
  Payload ID: 5186
  Gene Symbol: DST
  Gene Name: dystonin
  ENST ID: ENST00000421834
  CDS Start-End: 521-17014
cggcggccaggaaatgccgcagatgcgccgcgcagcatccccggtgaaggcagcgcgccggtcctcccgcaccgctgccgcggcctcggcccggcccgaagcacgcgcctcgtgcagggccagcagagcggtcagcgcggccgcagagggtccgggcgcccgccggcccccgcccgccctcgccgcacgccccgctcctccgcttggcgtggcgctgctcgtcgccgcccctgggctcgctgagatttgccgctgctgaaacccgagagggactcgggctcccggagccgggcggcccaccatcggcctgcccggaggcctgggcgtttcctttgccggccctggcgccggcagccccctgcgcccccgctctgcgtcttcggcttccgtgcttctccccagcgtgctgctccttcctcttttccagttcccaaggctgtgtcttgctgactgcgatactgtccgggggttacgagggggagaggggaatttgtcagtcatcgcttagataaacttcggcatggcgggttacctctcccctgctgcttacctgtacgtggaggagcaggagtatctccaggcctacgaggatgtcctggagaggtacaaagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgtctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaagaaagaacatgttgaaaaagccaaagaattgcaaaaatgggtatcaaatatcagcaagacattgaaagatgcagagaaggctggaaaacctcccttctctaagcaaaagatttccagtgaggaaatatcaaccaagaaggaacaattatcggaagcacttcaaactatacagctttttttggcaaaacatggagacaaaatgacagatgaagaaagaaatgaattggaaaaacaagtgaaaactcttcaggaaagttataatttattattcagtgaatctctgaaacagctacaagaatcacaaacctcaggagatgtaaaggtagaggagaagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatcttgcagcaagagagacggtggcaaggttgatacttctgcaacccacagagaagtgcagcgcaagttggatcatgctactgatcggttcaggtctctctactctaagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggctttgcaaggacagatatcaagtcagcaggttgctgtagagaaactgaagaaaacggctgaagtgcttttagatgccaggggatctttacttccagccaagaatgatatccagaaaacacttgatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaaggtcaagtgcctttaaactctactgctcttcaggatattatcagtaaaaacattatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggaatcaacttctgaatttttagaacacaagaaacatcttgaagttttgcatagtctcttgaaggagatatccagccatggcttaccaagtgataaggctttggtccttgaaaaaacaaataatttgtcaaagaaattcaaggaaatggaggataccatcaaagaaaaaaaagaagctgtaacttcttgtcaagaacagttggatgctttccaagttcttgttaaatcattgaagtcatggataaaagaaacaacaaaaaaagttcccattgtacagccttcttttggtgcagaggatttaggaaaatctttggaagacactaagaaattacaagaaaagtggagtttaaaaacaccagagattcagaaagtaaacaacagtgggatctcactatgtaacttaataagtgctgtgaccacccctgcaaaggcaatagcagcagttaaatcaggtggagcagtattaaatggtgaaggaacagccacaaatactgaggaattttgggcaaataaaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataagtcgtttgaggcagaactgaagcagaatgtaaacaaagtacaggagttgaaagacaaattgacagagctgttggaggagaacccagatactcctgaggcccccagatggaaacagatgttgacagaaatagattctaagtggcaagaactcaatcaattaacaattgatagacaacaaaaactggaagaatcctccaataatctaacccagttccagactgtagaggcccaattgaaacagtggcttgtggaaaaagaacttatggtcagtgttcttgggcccttgtcaattgacccaaatatgctaaacacacaaaggcagcaggtgcagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaacagaaaaaaaattgatgtctctgggtgacatcaggcttgagcaagaccagacttctgctcagcttcaagttcaaaagacattcaccatggagattttgagacacaaggatattattgatgaccttgttaaatctgggcataaaatcatgaccgcatgcagtgaagaggaaaagcaatcaatgaagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcggcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcatgggattctctaaataaagcttggaaagaccggattgacaaacttgaggaggcaatgcaggctgccgttcagtaccaggatggactgcaggcggtatttgactgggtagatattgcaggtggtaaattagcttcaatgtctccaattggaacagatctcgaaactgtcaagcagcagattgaagagctaaagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtgctccaaaatgatgtattagcccatcagtccacagtggaagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatgg

SEQ ID NO: 128706 - DNA, 9180 bp, Homo sapiens
  Payload ID: 5186
  Gene Symbol: DST
  Gene Name: dystonin
  Uniprot ID: Q03001
  ENST ID: ENST00000439203
  CDS Start-End: 1-9180
atgcacagtagtagttatagttaccgtagcagtgattctgtgtttagtaacactaccagcactcgaaccagtcttgattcaaatgaaaatcttctcttggttcattgtggtccaacactgatcaactcttgcattagcttcggcagtgaatcctttgatggacacaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaagaaagaacatgttgaaaaagccaaagaattgcaaaaatgggtatcaaatatcagcaagacattgaaagatgcagagaaggctggaaaacctcccttctctaagcaaaagatttccagtgaggaaatatcaaccaagaaggaacaattatcggaagcacttcaaactatacagctttttttggcaaaacatggagacaaaatgacagatgaagaaagaaatgaattggaaaaacaagtgaaaactcttcaggaaagttataatttattattcagtgaatctctgaaacagctacaagaatcacaaacctcaggagatgtaaaggtagaggagaagctggataaagtgattgcaggcaccattgatcagacaactggagaagtcctttcagtctttcaagcagttttaagaggcctcattgactatgacacaggaattaggttgcttgagacacagctaatgatttctggtctaatttcaccagaattaagaaagtgctttgaccttaaagatgccaaaagtcatggccttattgatgaacaaattctgtgccaactcaaagaactaagtaaagctaaggagattatttctgctgcgtcacctaccacaattccagtactggatgctctagctcaaagcatgataacagaatccatggccatcaaagttcttgagatactgctttctacaggctctctggttattccagccacaggagaacagttgaccctacagaaggctttccaacagaacttggtttcctcagcattattttctaaagttctggaaaggcaaaatatgtgcaaagatcttattgacccctgcacctctgagaaggtttctttaatagatatggtacaaagaagtactttacaggaaaacacagggatgtggcttctacctgtgagaccacaagaaggaggtagaataacattaaaatgtggaagaaacataagcattttaagagcagctcatgaaggtctcatagaccgtgaaaccatgtttaggttgttaagtgcacagcttctttctggaggtctgatcaattccaactctggccaaagaatgactgttgaagaagctgtcagagaaggggtgattgacagggacactgctagcagtatcctcacatatcaggttcaaactggtggaatcatccagtcaaaccctgccaagcgtttaactgtagacgaagcagtacagtgtgatttaataacttccagcagtgctcttctggtcctggaagctcagcgaggctatgttggactcatttggccccattctggtgaaatatttcccacatcatcttccttgcagcaagaattgattacaaatgaattggcctacaaaatcctgaatggcagacaaaaaatagctgctctttatattccagaaagttctcaagtcattggtttggatgctgctaaacagctaggaattatagacaacaacacagcatcaattttaaaaaatataacactgcctgataaaatgccagatttaggagatttagaagcttgtaaaaatgccagaagatggctctctttttgtaaatttcaaccctccacagttcatgattacagacaagaagaggatgtttttgatggagaagaacctgtcactactcagacctcagaagaaactaaaaaattatttctatcttatttaatgataaatagctatatggatgcaaacacagggcaaaggcttttgctgtacgatggagacttggatgaggctgttggcatgctactggaaggctgtcatgcagaatttgatggaaacacagccataaaagaatgtctcgatgtcttaagctcatctggtgtatttcttaataatgcttcaggtagagaaaaggatgaatgtacagctacaccaagtagtttcaataaatgtcactgtggagaacctgaacatgaagagactcctgaaaatagaaagtgtgctatagatgaagaatttaatgaaatgagaaatactgttatcaatagtgaattttctcagtcaggaaaactggcaagtacaatatcaattgatcctaaagttaacagttcacccagtgtgtgtgttcccagtctcatatcatatttaacacagactgaacttgcagacattagcatgcttagaagtgactctgaaaacatacttacaaactatgaaaatcaaagccgagtggaaacaaatgaacgtgcaaatgaatgtagtcattctaaaaacattcaaaactttccaagtgatttaatagaaaatcctattatgaaatcaaaaatgagtaaattctgtggtgtgaatgaaacagagaatgaagataatacaaacagggattcacctatctttgactattcccccaggctaagtgccttgttaagtcatgataaattgatgcacagtcagggaagttttaatgatacacacaccccagagagcaatggaaataagtgtgaagccccagccttatcattcagtgacaaaaccatgttgtcaggtcaaagaataggagaaaaatttcaagaccagtttctgggaattgcagctattaacatcagtttaccaggagagcagtatggacagaaatctttaaatatgatttctagtaatcctcaagtacaatatcacaatgataaatacatttcaaatacttctggtgaggatgaaaaaacacatccaggttttcagcagatgcctgaagacaaggaagatgagtctgaaatagaagagtattcctgtgctgtgactccagggggtgatactgataatgccattgtgtctcttacttgtgctacaccattgcttgatgaaaccatcagtgctagtgactatgaaacgtcactgctgaatgatcagcagaataacacaggaacagacactgatagtgatgatgatttttatgatactcccttgtttgaagatgatgaccatgattctttgcttcttgatggtgatgatcgtgattgcctgcaccctgaggactacgacacactgcaagaggaaaatgatgagacggcttctcctgctgatgttttttatgatgtctcaaaagagaatgaaaattccatggttccccagggggcaccagttggtagcttaagtgtgaagaacaaagcacattgtcttcaggatttccttatggatgttgagaaagatgaattagattctggtgaaaaaatacatttaaatcctgttggctcagataaggtgaatggacagtcactggaaactggatcagaaagggaatgcacaaatatccttgaaggtgatgaatctgactcattgactgattatgatattgtaggaggaaaagagagcttcactgcatcattaaaatttgatgacagtggcagttggagaggaagaaaggaagagtatgtaactggacaggaatttcactccgatactgatcatttagattctatgcaaagtgaagaaagttatggggattatatatatgacagtaatgatcaggatgacgatgatgatgatggcattgatgaagaaggaggaggtataagagatgagaatggaaagcccaggtgccaaaatgtggctgaagatatggatatccagttgtgtgcctctattttaaatgaaaacagtgatgaaaatgaaaatattaatacaatgattcttctggataaaatgcacagttgtagctctttagaaaaacagcaaagggtaaatgttgtacagctagcatcacctagtgaaaataacttagttactgaaaaaagcaaccttccagaatatacaactgagattgctggaaaaagcaaagaaaatctgttgaaccatgagatggtacttaaggatgtattgccgcctatcattaaagacactgaatctgaaaaaacttttggccctgcaagtatttcacatgataataataatatcagttcaacttctgaattaggtactgatctagcaaacacaaaggttaagttgattcaagggtcagaattgccagaattgactgattctgtgaaaggtaaagatgaatattttaagaatatgacaccaaaagttgactcatctcttgatcacatcatttgtactgagcctgatttaataggaaaacctgctgaggaaagccatttgtcattgatagcctctgtaactgacaaagatcctcaaggaaatggaagcgatctcattaaagggagagatggcaaaagtgatattctaatagaagatgaaacatcaattcagaaaatgtacttgggtgaaggagaagtgcttgtagaaggtctagtagaagaagaaaataggcatctcaaacttttgcctggtaaaaatacaagggatagtttcaagttaattaatagtcagtttccatttccacaaatcacaaacaatgaagaacttaatcagaaaggaagccttaaaaaagcaactgtaactcttaaagatgaaccaaataatctacaaataatagttagtaaaagtcctgttcagtttgagaatcttgaagaaatttttgacacatcagtttccaaagagattagtgatgacattacttcagacattacatcgtgggaagggaatacacattttgaggagtcattcactgatggacctgagaaagagcttgatctgtttacttacttaaaacattgtgctaaaaatataaaagcaaaagatgtagccaaaccaaatgaagatgtcccaagccatgttttaataactgcccctcccatgaaagaacatttacaattaggagttaataatacaaaagagaagtccactagtacccaaaaagactcacctcttaatgacatgatccaaagcaatgatctttgtagtaaagaaagcatctcaggaggaggaacagaaatttctcagttcacaccagaaagtattgaagccacactttcaatattatctcgtaaacatgtagaagatgttgggaaaaatgattttctgcagtcggagcggtgtgcaaatggattaggaaatgataactccagtaacactttaaatactgactattcattcttagaaattaataataagaaagaaagaattgagcaacagctaccaaaagaacaagccttgtctccaagatcccaagaaaaggaggttcagattcctgaattgtctcaggtatttgtggaggatgtaaaggatatcttaaaaagcaggttgaaagaaggtcatatgaaccctcaagaggttgaagaaccttcagcctgtgcagacactaaaattttaattcaaaatttaattaaaaggattaccacatcacagttggtaaatgaggcatctactgtgcccagcgactctcaaatgagtgactcttctggagtttcccccatgactaactcatcagaactaaagccagaaagtagagatgatcctttctgtattggaaatcttaagtctgagcttctccttaatatattgaagcaagatcaacatagccaaaaaattacaggagtatttgaattgatgagagaattaactcatatggagtatgacctagagaaaagaggcattacgtctaaagtacttccactgcagcttgaaaatattttctacaaactgcttgctgatggatattcagagaaaatagaacatgttggagactttaatcaaaaagcatgttctacatctgagatgatggaagaaaagccacatattcttggtgatattaaaagcaaagaaggaaactactattctcctaatttagaaactgtaaaagaaattggactagaaagctctactgtgtgggcatcaacattgccaagagatgagaagctcaaggatctgtgtaatgatttcccaagccatttggaatgtacttcagggtctaaagagatggcttctggagatagctcaaccgaacaa

SEQ ID NO: 128707 - DNA, 530 bp, Homo sapiens
  Payload ID: 5186
  Gene Symbol: DST
  Gene Name: dystonin
  ENST ID: ENST00000522360
  CDS Start-End: 1-530
cacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagatagctaagaacaagcagtatgatatgcatacagaagtcacaacattaaaacaagaaaagaacccagttcccagtgctgaagaatggatgcttgaagggtgcagagcatctggtggactcaagaaaggggatttccttaagaagggcttagaaccagagaccttccagaactttgatggtgatcatgcatgttcagtcagggatgatgaatttaaattc

SEQ ID NO: 128708 - DNA, 565 bp, Homo sapiens
  Payload ID: 5186
  Gene Symbol: DST
  Gene Name: dystonin
  ENST ID: ENST00000522538
  CDS Start-End: 166-565
aataaggaagagggggaggagccaagatggccgaataggaacagctccggtctgcatctcccagcgtgagcgacgcagaagacgggtgatttctgcatttccatttgagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatg

SEQ ID NO: 128709 - DNA, 545 bp, Homo sapiens
  Payload ID: 5186
  Gene Symbol: DST
  Gene Name: dystonin
  ENST ID: ENST00000523817
  CDS Start-End: 84-545
ctgcgatactgtccgggggactctgacacatcagagtttgtacggagagagtttagggaactgctgcacagatttcctgcagaatgatggggcagctcatgaaaaatgatcaagattggaacgcaaagctggtgggactgatgtgctgtatggatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacg

SEQ ID NO: 128710 - DNA, 490 bp, Homo sapiens
  Payload ID: 5186
  Gene Symbol: DST
  Gene Name: dystonin
  ENST ID: ENST00000523943
  CDS Start-End: 1-372
gaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggaggtttggaaattcataccctcaacaccacattgtcatttgccctcattcctcataacacattgccattgccaaaatcttggtattttttaacttttctgataataagcaaactcttgctatttgagtacatttttaaatttccaaaataaataccacaagtatgtgtgattttgtgaaatattgatatatgggatttggatttagggaa

SEQ ID NO: 128711 - DNA, 3547 bp, Homo sapiens
  Payload ID: 5186
  Gene Symbol: DST
  Gene Name: dystonin
  ENST ID: ENST00000518935
  CDS Start-End: 73-3504
gctttttccagacctcctaccttttagtctactttgaaaggtgaaagaaagaacatcgtttcaggaataaaaatgcacagtagtagttatagttaccgtagcagtgattctgtgtttagtaacactaccagcactcgaaccagtcttgattcaaatgaaaatcttctcttggttcattgtggtccaacactgatcaactcttgcattagcttcggcagtgaatcctttgatggacacaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggaggtaatcattaacagtgagcaccctgtaaatataaaggagctagagatgagcagtaactacagtgtagtttgggaaagcaaaacatgtttcatgataaatttatgtggccggtagcagatgtacaaataaatattgaattataaaattacaatgaaaa

SEQ ID NO: 128712 - DNA, 1724 bp, Homo sapiens
  Payload ID: 5186
  Gene Symbol: DST
  Gene Name: dystonin
  ENST ID: ENST00000523292
  CDS Start-End: 1-779
tgacaaggcaggtagctaagtgtaaatgtgcaaagcgatttcaagttgagcagattggtgataataaatacaggtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaattta

SEQ ID NO: 128713 - DNA, 4598 bp, Homo sapiens
  Payload ID: 5186
  Gene Symbol: DST
  Gene Name: dystonin
  ENST ID: ENST00000520645
  CDS Start-End: 162-4598
aggtttgtaacaggaaggctgttgattctggcttcattgttgggccagtcatttgtgagctggtggccggaccacaggccacacacttcttccgtgcaaatcttcatgtattgaaactgcctgtgtattgtttttacgattggagacttggccaagaaaagatgagttccgggaacgcgtcctatcgctgctctatgtcttcctctgcggatttttccgatgaggatgatttcagccagaaatctggctccgcatccccagctccgggagacaccttaccctggaatttgcctaaacatgagagatcgaaaagaaagattcaagggggctcagtgctggaccctgccgagagggcagtgcttcggatagcagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgtctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaag

SEQ ID NO: 128714 - DNA, 1778 bp, Homo sapiens
  Payload ID: 5186
  Gene Symbol: DST
  Gene Name: dystonin
  ENST ID: ENST00000518398
  CDS Start-End: 1-1346
aagttgtgacaacagcaatcaaggaagaaactgaaaaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatcttgcagcaagagagacggtggcaaggttgatacttctgcaacccacagagaagtgcagcgcaagttggatcatgctactgatcggttcaggtctctctactctaagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggctttgcaaggacagatatcaagtcagcaggttgctgtagagaaactgaagaaaacggctgaagtgcttttagatgccaggggatctttacttccagccaagaatgatatccagaaaacacttgatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaagatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggaatcaacttctgaatttttagaacacaagaaacatcttgaagttttgcatagtctcttgaaggagatatccagccatggcttaccaagtgataaggctttggtccttgaaaaaacaaataatttgtcaaagaaattcaaggaaatggaggataccatcaaagaaaa

SEQ ID NO: 128715 - DNA, 912 bp, Homo sapiens
  Payload ID: 5186
  Gene Symbol: DST
  Gene Name: dystonin
  ENST ID: ENST00000633795
  CDS Start-End: 1-912
atggggaatgtctgtggatgtgtaagagctgagaaagaagaacaatatgtagatcctgccaaaactcctttgaaccctgaaaaatactctcctggaagaaaatatttcagaagaaaaccgatcaaaaaaactggaggtgacaaagagtcagttggggcaaacaatgaaaatgaaggcaagaagaagagcagcagtcagccttcaaaagaacagccagctcctttatccaggggactggtacagcaggaatctgttaccctaaactctgcactgggagatggtattcagcaaaagaagacagaagttgtagctgacagcgttaaacagaaacttctgccgagtgctgtaagcagttggtctgactgtgtgaacacttctcctgctaaagacagtgaaacagaagtaaaagttagtgaactggatgaaaggatttcagaaaaagacagcactccatattgcgcaaagaggaagaaacatttagatgatgtcaacacaagcgaaataacattccaggaaaaaactgatgttttttctttccgaaaggcagccagcttaagctctattccctcgggtatagaaagatcactcgaaaaaagtgggtttcctgaagacccaccaaaaagttatagcagtattcaagaaaagcaaaacactgagagattttgccctcatgcaacacagcattttcagtttaaaaaaaagagatgccattccctttatactagtatgtcctctgtttctaaggacacagatggaaatgagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgcc

SEQ ID NO: 128716 - DNA, 5024 bp, Homo sapiens
  Payload ID: 5186
  Gene Symbol: DST
  Gene Name: dystonin
  ENST ID: ENST00000340834
  CDS Start-End: 1-5024
atggggaagccactcagcagaccagactgtttacgtcagaatcccccatgtgtagggaagggtgaagaagaggaggacctaaatatcgaagactgttacgtcccacagcggtcaatctatgatactgttagactaaatgaacagatagactctggttcaaaaggtagtctatcttccaggcattttacagatcgaactttaccctacagtcacagaacactggatgttagttctttatgctctaatggtgcccttacttcttccagtgtatttgagctgagaggtcgggaagctaacaaactagatgaaaagatgatctttgatgcactcaaactaaatagtgatatcattcgaaccacaggattacctaaagccaaatctcatgcggaaaagaaagagcatagacggtcatggcgaatgtttgtcccggccaattttatggattatgcaaacaaaagtgaaagctcttttgttgaacctgctgatatgtcagatgctgttaccaaggccagcaagtgcagatggggtactaattctctcacttcggaggaggatgactctggtttatgtagccctccagcagagagggaagaaaaacagggcattttaactggagaccagtcacgaattaaaagtttgtcttctactgaagatattcttgtaacagaccaatacagaccatttttttctgttaattccattagcgaacagaaaatcccactgctttcatgtcaaagtgcccaccctgatgaaaatttcaaaatgattttacatgatgtttctccactagaggaagcaaaacatgtaaatggtcaaagggaaatccacgatgaaaattgttgcctgcagaataatttgaaagagagccctgtgaagtgtgacccattaattatgccaagaaatagagaaaatgagcatatttttaaccttggagaagaggacgaaacatacggacctggagaatcccaaatcacagcacaaagtagggaactcttgaaggattcccctcaagatttagatctctctcacacagatctaggggagagtgatgtagattgtggtagcaccagcttagtagaaaatgtgacacttttgacacaatatgattcaggagaatgcaacattgcatctaaagaggaagtggaggctcctctttctgcccaggagagcgaaatgctctataagaagttctccctgaaattcgtatcagcaagaaagaaagcagcacccagaaaaacaggggcccaggcaggaatattggacacagtctgcaatggctttcagttggttcaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaacagaaaaaaaattgatgtctctgggtgacatcaggcttgagcaagaccagacttctgctcagcttcaagttcaaaagacattcaccatggagattttgagacacaaggatattattgatgaccttgttaaatctgggcataaaatcatgaccgcatgcagtgaagaggaaaagcaatcaatgaagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcggcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcatgggattctctaaataaagcttggaaagaccggattgacaaacttgaggaggcaatgcaggctgccgttcagtaccaggatggactgcaggcggtatttgactgggtagatattgcaggtggtaaattagcttcaatgtctccaattggaacagatctcgaaactgtcaagcagcagattgaagagctaaagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtgctccaaaatgatgtattagcccatcagtccacagtggaagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacat

SEQ ID NO: 128717 - DNA, 569 bp, Homo sapiens
  Payload ID: 5186
  Gene Symbol: DST
  Gene Name: dystonin
  ENST ID: ENST00000524186
  CDS Start-End: 550-569
agatggtgcctgaagagagagggcgttgctgcaagcgccctggctggagagcatgcctgcccggcaccgtgctgccctgaggagccgcggacagccccggagctcccttccggagttctttctgctgcctccaccgccaccgtctctctctagccccagctgaaatgaaggccataccgcggccacagaacttggttcagtttcaaaggctaatgtagtccctgggttttctgctcaatgtgaattacgctgcctgtgccttagaggaagccgcggagctcttcgttgctgcaattgcctcaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagct

SEQ ID NO: 128718 - DNA, 1403 bp, Homo sapiens
  Payload ID: 5187
  Gene Symbol: DTNBP1
  Gene Name: dystrobrevin binding protein 1
  Uniprot ID: Q96EV8
  ENST ID: ENST00000344537
  CDS Start-End: 174-1229
acgcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggtaaactgaga

SEQ ID NO: 128719 - DNA, 1880 bp, Homo sapiens
  Payload ID: 5187
  Gene Symbol: DTNBP1
  Gene Name: dystrobrevin binding protein 1
  Uniprot ID: Q96EV8
  ENST ID: ENST00000338950
  CDS Start-End: 107-1018
gtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttaggtagggttgacaaacttgcattagctgaaccagggcagtatcgatgccactcccctccaaaggtgagacgtgagaaccatctgccagtcacttacgcataaacccccaagctcacagccagctcctggctccctaaccccacggttccacacggctgtgtggcagctgcaacagtggtgtggttccgtcatgaattcttctcaaagatttgacatgctccactccggtaactttggtgagttgagagctttcttgtttgttttccctcctttaccacccagaaatccatttgagtctgctccttgtggttaaggactggcgtttgcagggaggtgcggactctcctgcggggctcacgggaaactcttccctcttcgtgcgacaggcatttaggggcgtgcctgccatgggcaaagccatggtgtgtgttcagctcttggcctgtgttgtaaacttagttgcacttcagttcctttcatcccttcacaaaattttgtttcacattcatgcagcaaatatgggctgaggtgccagacctgtacctgggcttggtgcgtttcaaatttcagaccagttctttgggctgggtcaaggcaaagctcagtcgtcccagcagcacctcagccatctgtagaaggttctaccattaccacggtttcagcttcctctaaacttctcacccgcttctcctggcaatctgtcagaacggtgtcatcctggggaagagaaggagcttgggtgcatttgccctcatcctgagaaggccagaatactggagaccagcgtgaaccctcacccagagtcaggggaagatttagaaacagtgacacctgcatatagaattttgattccttgaagagcctatttagttccataaaattggagaactgctgaaggtcagtaattccgactttctcagcagtggtgtctctgaattactgcaaagggtaaaaaaaaaaaaaa

SEQ ID NO: 128720 - DNA, 1359 bp, Homo sapiens
  Payload ID: 5187
  Gene Symbol: DTNBP1
  Gene Name: dystrobrevin binding protein 1
  ENST ID: ENST00000355917
  CDS Start-End: 190-1194
cgcgcgcggggcgggaacgcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggt

SEQ ID NO: 128721 - DNA, 498 bp, Homo sapiens
  Payload ID: 5187
  Gene Symbol: DTNBP1
  Gene Name: dystrobrevin binding protein 1
  ENST ID: ENST00000509674
  CDS Start-End: 72-498
agattgtgttgaacggccatgaatccatagcagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaag

SEQ ID NO: 128722 - DNA, 1542 bp, Homo sapiens
  Payload ID: 5187
  Gene Symbol: DTNBP1
  Gene Name: dystrobrevin binding protein 1
  ENST ID: ENST00000506844
  CDS Start-End: 52-192
agaggcagcagcagcccgaggcctgaggagaggagaccggcggcggcggcaatgctggagacccttcgcgagcggctgctgagcgtgcagcaggatttcacctccgggtcactttcagctgacaaaccactggactgtcagtgtgtgccattagcctgtcacctggtggagaaacaactcatctccaagtgatgtcagtctcccagtagacccggacctctagtgcctgatgttcactttcttcaggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttaggtagggttgacaaacttgcattagctgaaccagggcagtatcgatgccactcccctccaaaggtgagacgtgagaaccatctgccagtcacttacgcataaacccccaagctcacagccagctcctggctccctaaccccacggttccacacggctgtgtggcagctgcaacagtggtgtggttccgtcatgaattcttctcaaagatttgacatgctccactccggtaactttggtgagttgagagctttcttgtttgttttccctcctttaccacccagaaatccatttgagtctgctccttgtggttaaggactggcgtttgcagggaggtgcggactctcctgcggggctcacgggaaactcttccctcttcgtgcgacaggcatttaggggcgtgcctgccatgggcaaagccatggtgtgtgttcagctcttggcctgtgttgtaaacttagttgcacttcagttcctttcatcccttcacaaaattttgtttcacattcatgcagcaaatatgggctgaggtgccagacctgta

SEQ ID NO: 128723 - DNA, 1518 bp, Homo sapiens
  Payload ID: 5187
  Gene Symbol: DTNBP1
  Gene Name: dystrobrevin binding protein 1
  ENST ID: ENST00000513680
  CDS Start-End: 190-330
cgcgcgcggggcgggaacgcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggtcactttcagctgacaaaccactggactgtcagtgtgtgccattagcctgtcacctggtggagaaacaactcatctccaagtgatgtcagtctcccagtagacccggacctctagtgcctgatgttcactttcttcaggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgaggcgacccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaactt

SEQ ID NO: 128724 - DNA, 1404 bp, Homo sapiens
  Payload ID: 5187
  Gene Symbol: DTNBP1
  Gene Name: dystrobrevin binding protein 1
  ENST ID: ENST00000510395
  CDS Start-End: 139-273
ggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccagttggctaaatcaagaacagttttaataagtgtttcttttgggcaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggt

SEQ ID NO: 128725 - DNA, 1306 bp, Homo sapiens
  Payload ID: 5187
  Gene Symbol: DTNBP1
  Gene Name: dystrobrevin binding protein 1
  ENST ID: ENST00000515875
  CDS Start-End: 162-788
ctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgaggcgacccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaa

SEQ ID NO: 128726 - DNA, 1010 bp, Homo sapiens
  Payload ID: 5187
  Gene Symbol: DTNBP1
  Gene Name: dystrobrevin binding protein 1
  ENST ID: ENST00000462989
  CDS Start-End: 255-842
tttgcacactagagcccctgagagcttgcattttgcttttatagaggcagtagattccaatgtatatctgcttaagccatcagcaaaaaactaataggcttactacaatttctttggaaaaacctgcttctggcttcagcctcacttcctttgttctacatcccagaagatgcacgtgagggcagctgcctggtaactggaggcttcacttgaccagcactgagcttctgttcactccttcaggtctcacatccatgtcatctccaggactcaccgaaaatagtcagagggatccctctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggtaaa

SEQ ID NO: 128727 - DNA, 843 bp, Homo sapiens
  Payload ID: 5187
  Gene Symbol: DTNBP1
  Gene Name: dystrobrevin binding protein 1
  ENST ID: ENST00000511762
  CDS Start-End: 152-843
ggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgct

SEQ ID NO: 128728 - DNA, 1305 bp, Homo sapiens
  Payload ID: 5187
  Gene Symbol: DTNBP1
  Gene Name: dystrobrevin binding protein 1
  ENST ID: ENST00000622898
  CDS Start-End: 190-1140
cgcgcgcggggcgggaacgcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggt

SEQ ID NO: 128729 - DNA, 1964 bp, Homo sapiens
  Payload ID: 5188
  Gene Symbol: DTNA
  Gene Name: dystrobrevin, alpha
  Uniprot ID: Q9Y4J8
  ENST ID: ENST00000269192
  CDS Start-End: 346-1704
agagttaaagggaatatcaaggatggtggcagaattaaagggcaaacttaccttccatcccaggtctagtattcagtcccccttcctcccactctccaccctactgcgtgctcttacttattctgttggaacccagtgtagcttcctgagatttaaaatataggaagactcaaaactatgttacttcttggaatatagataattcagtactgatttaaataacaactgaatagcaaggaccttctggaacataatcttacattcacaaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggaggttacctgagggaataagtgcatccagccctgtggctgaagagcattccctcataaagctgtacgtaaatcagcttgatcacggtgcacgctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttc

SEQ ID NO: 128730 - DNA, 6522 bp, Homo sapiens
  Payload ID: 5188
  Gene Symbol: DTNA
  Gene Name: dystrobrevin, alpha
  Uniprot ID: Q9Y4J8
  ENST ID: ENST00000283365
  CDS Start-End: 352-2412
aggatgagatcatagtttcaggatcctcaggaaaccctggtactggcagcagccagcctctgctgtgcccacatgacccacaactctggcagcggacccggcacttccaacattattaaataataagaaagcggctcctactccaggctcaaacctccctgcagaccaatggacaccttctaagagtttggcgagtcagtgactgaagcgcccgtccattccaagataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttcaagaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtg

SEQ ID NO: 128731 - DNA, 1706 bp, Homo sapiens
  Payload ID: 5188
  Gene Symbol: DTNA
  Gene Name: dystrobrevin, alpha
  Uniprot ID: Q9Y4J8
  ENST ID: ENST00000315456
  CDS Start-End: 325-1449
caggaaaccctggtactggcagcagccagcctctgctgtgcccacatgacccacaactctggcagcggacccggcacttccaacattattaaataataagaaagcggctcctactccaggctcaaacctccctgcagaccaatggacaccttctaagagtttggcgagtcagtgactgaagcgcccgtccattccaagataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagctcggacggtgcttttggtggatgcgtctagatggataacatgacttcttctaccctaaaatattcctataatactttgagctgttctggttcctccagggtgcatggtacccattaacccaaaatatgattatttcccttttttcccattttcagtcattttggaatgttctctgtgaaccacagttgtgttgtttaaagctcacatttctttctgtcaccacagagattggcctacggtttctgttttgagggtgctgttcaataaagctgtgtacactaaatgtc

SEQ ID NO: 128732 - DNA, 4518 bp, Homo sapiens
  Payload ID: 5188
  Gene Symbol: DTNA
  Gene Name: dystrobrevin, alpha
  Uniprot ID: Q9Y4J8
  ENST ID: ENST00000348997
  CDS Start-End: 164-1867
ttgagcacaaggggaagaatgaacacagctttttattgaagttaaaggttactttggagtttgtttggaaatgtgtaaggtcaaatactatagttttcagcatatgtagtacttcagaggaagaattaaggggcatgttggtgcatttaactacaaaaccagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaactaacagtggaggggcctgccgacctgcggttttctcattgcttttgctctaatgtatgttcatgcttcagtttggaaagagaaaaaagtcatactaatttgcttctttttcaatgtagtgcttgaattgagatatataaatttagcattttttataactatcactactatccacatcaaaagaagaactatgacatcttttagaaaagggaacgaattgtcatttattggaaacattttagatccccagaggtataagtttcaaaccagtcttagcttttcaagttgttgatcagacccttctcttaacagagagataccacagtcactagagataccctgaggttcatgtcatcccaaaacccacagcactcagaagctaacctctacacccactcacactgtgagtattcagttcggtttcattttactgaaaacctgtgaaacctctttttataaaaatcaggcaattaaatcccttttcatcacacaattattgagccttgttccccatggctcaccaaaatgtgctcaattttgtgagagaaagactgtactccataactgactattcacgtcccatctttttggctcttccccaaagcagaatccttactgttggttgacagtaatctctttttaaaaagtaactctcagctttttccttagcaccagagcctttcggctccgggagacgagagggtcattacatacttttttttttttctggaaataggggcattgtgactttatagcctaaactggagctgtctgaacctgtggtcaggctcaagagccagcagggggagcagcaaactcaaaaaaaaaaacaaattaaattaaattaaattaaattaaatagaagcaaaataaaagcagctttaatttcaagtgcatgtaccacgctatgtatgacaatatatcccactcactagcattatttaaaagtttcacattatttccatggatcaattagaaccacaacctgtccaatttcaacgtatctttcatttcttctgtatgctcttttctattattcattatgtgtgtttgtgtgtaacaaagaatgtttggaaaatgctggacacatttttacccttcattcccatggtctgtaaaaaaggaaagtgtaaaatcaatctgtaatgtcagacaataaagataatgtattacattattttgtattttgtgaaaaaaattactttactaaattaaagtcaaattttaacagaagacagtccccctgggtgaaggacacataacacatacagcctgtataattgcccatgaatgcatacatggggtattgctattgtatttccaatacacttagatcatggtaaagaaaaatgccttcttcatgatacttctctgcaaatggcttctttcctctcctgtctcttatttagcatgtgcatagaaaaaggaaataaggttcaattataacctccctcctcctagcagagagagagggcaatcatcctgtcgtcatcagccttgctttagccatttcccttggggatactttccaggccatttcccaggcagcaggatcttgaaaggctcctatggaccaggaagttcgtaaacagatggatgcacagagccaaactgtggcagtgcccccaaggtggcgccactgccccctcaccttccagctcctctccaccaagcccctcagcagcttctgcatctcagggggccaacagcgggtactgcggtgtcggtacccaaggaccagggcccacgtcacccagatgtcagcaatacatcgtctgggtagtggcagagtttgcctatttcacttatttatcttttttgcttttatacacaagcctcttttcaaaaaggacctgaggcagcttacaacaaaagatataaacagtgacttcataaaattgaaatagaaaaatcaaaaactaaagaaaataaaatgtgaatatgctaatcttaagggacaaggatgttactctgcatgttctggcaatgaagcaaaaaaaaaaaaaaaaggaaaattatcggtggttttatcagtacagaaataccacttctcaggggaacaaaatttctgttggcataaaatatgaaagaaagtcttcactgggagctttataggagtactggacgatagaaaaggaaaaaaagcagtcatagatttcatgtggctgtttcttatactgacctcagtcaaaattaaaagcagaaccttatcaatcccagccctatagaggcggttctgcaaggaaataaacaaatgctgtccaaatatagacttctcatggtaaaacatgatctaaggagagaatttagaggttttagactggcatctgcttctaaattctgtttttatttatgagtgtttctcccctttggggacattgtctttgtaaaaccaaacttagaacacccccacacaacaaattgtgctggatttaataacctctacttgctttatcataagtctgtgtggttcaatgtagtgttttattatactggcatatataatttctacttacattgtttcttgttagaggtaatgcatgaatttatccctctcgaggagagaacatgaattaaaaaaaatagtgcctgtaatataatgtgatgattatgatatcacaagcaataaatttttttttacaaaacttgaa

SEQ ID NO: 128733 - DNA, 2232 bp, Homo sapiens
  Payload ID: 5188
  Gene Symbol: DTNA
  Gene Name: dystrobrevin, alpha
  Uniprot ID: Q9Y4J8
  ENST ID: ENST00000399113
  CDS Start-End: 1-2232
atgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttga

SEQ ID NO: 128734 - DNA, 6490 bp, Homo sapiens
  Payload ID: 5188
  Gene Symbol: DTNA
  Gene Name: dystrobrevin, alpha
  Uniprot ID: Q9Y4J8
  ENST ID: ENST00000399121
  CDS Start-End: 308-2380
agaggctggatttcatactcatagctctccctagaatttcagagagttctgttatgatctctgttgtaattaccaatttggttcaagtttgttctttaaatgaatatgcttagaattcacatatgttctggatgtactggaattaaaaggatttaagagatcatggtgtgcatgttctaggataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggaactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttcaagaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtg

SEQ ID NO: 128735 - DNA, 6343 bp, Homo sapiens
  Payload ID: 5188
  Gene Symbol: DTNA
  Gene Name: dystrobrevin, alpha
  Uniprot ID: Q9Y4J8
  ENST ID: ENST00000444659
  CDS Start-End: 2-2233
aatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttcaagaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtg

SEQ ID NO: 128736 - DNA, 1680 bp, Homo sapiens
  Payload ID: 5188
  Gene Symbol: DTNA
  Gene Name: dystrobrevin, alpha
  Uniprot ID: Q9Y4J8
  ENST ID: ENST00000554864
  CDS Start-End: 308-1423
agaggctggatttcatactcatagctctccctagaatttcagagagttctgttatgatctctgttgtaattaccaatttggttcaagtttgttctttaaatgaatatgcttagaattcacatatgttctggatgtactggaattaaaaggatttaagagatcatggtgtgcatgttctaggataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctcggacggtgcttttggtggatgcgtctagatggataacatgacttcttctaccctaaaatattcctataatactttgagctgttctggttcctccagggtgcatggtacccattaacccaaaatatgattatttcccttttttcccattttcagtcattttggaatgttctctgtgaaccacagttgtgttgtttaaagctcacatttctttctgtcaccacagagattggcctacggtttctgttttgagggtgctgttcaataaagctgtgtacactaaatgtc

SEQ ID NO: 128737 - DNA, 1626 bp, Homo sapiens
  Payload ID: 5188
  Gene Symbol: DTNA
  Gene Name: dystrobrevin, alpha
  Uniprot ID: Q9Y4J8
  ENST ID: ENST00000556414
  CDS Start-End: 335-1522
gaatatcaaggatggtggcagaattaaagggcaaacttaccttccatcccaggtctagtattcagtcccccttcctcccactctccaccctactgcgtgctcttacttattctgttggaacccagtgtagcttcctgagatttaaaatataggaagactcaaaactatgttacttcttggaatatagataattcagtactgatttaaataacaactgaatagcaaggaccttctggaacataatcttacattcacaaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggaggttacctgagggaataagtgcatccagccctgtggctgaagagcattccctcataaagctgtacgtaaatcagcttgatcacggtgcacgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacag

SEQ ID NO: 128738 - DNA, 576 bp, Homo sapiens
  Payload ID: 5188
  Gene Symbol: DTNA
  Gene Name: dystrobrevin, alpha
  ENST ID: ENST00000588684
  CDS Start-End: 521-576
agaggctggatttcatactcatagctctccctagaatttcagagagttctgttatgatctctgttgtaattaccaatttggttcaagtttgttctttaaatgaatatgcttagaattcacatatgttctggatgtactggaattaaaaggatttaagagatcatggtgtgcatgttctaggataaataggatttaccaatccttggatgaagtgcttgggaagtctttaagtgccataatcaactgccatttcaaagaatatagatggttttgaaaagttcatgctgtcccttcattgaattttagaggtcatctcaactgctcatctgtccattttaatgtactgtggttggactctgaaggacatgatgttccttctaccaacaattttcatctattcaaccaatgtcaatgttgaacctgcaatgcctaatttagaatcctttcagacaatgcgcaaatgccatcatgaacagaatttctaaaactccttcatcatcctaaagctgggagacacagaatgattgaagatagtgggaaaagaggaaataccatggcagaaagaagacagctgtt

SEQ ID NO: 128739 - DNA, 604 bp, Homo sapiens
  Payload ID: 5188
  Gene Symbol: DTNA
  Gene Name: dystrobrevin, alpha
  ENST ID: ENST00000590412
  CDS Start-End: 246-604
gcgccgcagccaggactgcggcgcggcgcctccccgggcggcgggcggcgcctcaggcccgcggggcggcggtagcggctgctgcaggatgtccggcccgggggcgcggggccgcgcagataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttga

SEQ ID NO: 128740 - DNA, 534 bp, Homo sapiens
  Payload ID: 5188
  Gene Symbol: DTNA
  Gene Name: dystrobrevin, alpha
  ENST ID: ENST00000591816
  CDS Start-End: 434-534
attttcaagttaaagatagacacagtacacaccaggatctagaggctggatttcatactcatagctctccctagaatttcagagagttctgttatgatctctgttgtaattaccaatttggttcaagtttgttctttaaatgaatatgcttagaattcacatatgttctggatgtactggaattaaaaggatttaagagatcatggtgtgcatgttctaggataaataggatttaccaatccttggatgaagtgcttgggaagtctttaagtgccataatcaactgccatttcaaagaatatagatggttttgaaaagttcatgctgtcccttcattgaattttaggtaatttcctgaatttgattacgatggagagaagcagctaaaagtctacactgaatgattgaagatagtgggaaaagaggaaataccatggcagaaagaagacagctgtttgcagagatgagggctcaagatctggatcgcatccgactctccacctacagaacagcatgcaagcttaggtttgttca

SEQ ID NO: 128741 - DNA, 587 bp, Homo sapiens
  Payload ID: 5188
  Gene Symbol: DTNA
  Gene Name: dystrobrevin, alpha
  ENST ID: ENST00000588125
  CDS Start-End: 458-587
agacacagtacacaccaggatctagaggctggatttcatactcatagctctccctagaatttcagagagttctgttatgatctctgttgtaattaccaatttggttcaagtttgttctttaaatgaatatgcttagaattcacatatgttctggatgtactggaattaaaaggatttaagagatcatggtgtgcatgttctagggacaacggttctcaaaatgaagacactttcatgagattcttgaggttaaaactattttaataacaactctatcatattatttgcctttttcactatgggacagtcacacagatgtgcaaaagtaatgataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttg

SEQ ID NO: 128742 - DNA, 1787 bp, Homo sapiens
  Payload ID: 5188
  Gene Symbol: DTNA
  Gene Name: dystrobrevin, alpha
  Uniprot ID: Q9Y4J8
  ENST ID: ENST00000591182
  CDS Start-End: 336-1511
ggaatatcaaggatggtggcagaattaaagggcaaacttaccttccatcccaggtctagtattcagtcccccttcctcccactctccaccctactgcgtgctcttacttattctgttggaacccagtgtagcttcctgagatttaaaatataggaagactcaaaactatgttacttcttggaatatagataattcagtactgatttaaataacaactgaatagcaaggaccttctggaacataatcttacattcacaaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaaggcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttcaagaaggaaaaaaaaa

SEQ ID NO: 128743 - DNA, 556 bp, Homo sapiens
  Payload ID: 5188
  Gene Symbol: DTNA
  Gene Name: dystrobrevin, alpha
  ENST ID: ENST00000590727
  CDS Start-End: 244-556
ttcatttcatttccccacaggcatgattgaaaagggttgtaagattccaggaatgaactaaatgtttctctgagcccaaatcaactatcatctgaaatcgtggtgcagagaagaaaggtgcaattcctgtaaggctgtatttttccttcttctggttcatacttttgttttcttggtttttcttcacttacttcccccttagtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcag

SEQ ID NO: 128744 - DNA, 555 bp, Homo sapiens
  Payload ID: 5188
  Gene Symbol: DTNA
  Gene Name: dystrobrevin, alpha
  ENST ID: ENST00000587723
  CDS Start-End: 228-555
agtgctccctgagctctgccgagagtaatttcctaccagccctgctgggagtttcaccccaagagagcagccttcaacagagctgctgggtgtcatgaagatagagggtgtgggtgtgaatagcctggctctaagagctttgctgcttcccactcctccaaagaattagaacgtgatgcactgcaacgtaaaagtccatttcacagcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaa

SEQ ID NO: 128745 - DNA, 682 bp, Homo sapiens
  Payload ID: 5188
  Gene Symbol: DTNA
  Gene Name: dystrobrevin, alpha
  ENST ID: ENST00000590598
  CDS Start-End: 284-682
cttgcagtttgatctcagactgctgtgctagcaatcagcgagactccgtgggcgtaggaccctccgagccaggtgcgggatataatctcatggtgtgccgtttttaaagctggtccgagaagcgcaatattctggtgggagtgacccgattttccagataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaa

SEQ ID NO: 128746 - DNA, 578 bp, Homo sapiens
  Payload ID: 5188
  Gene Symbol: DTNA
  Gene Name: dystrobrevin, alpha
  ENST ID: ENST00000588949
  CDS Start-End: 276-578
gaagaatgaacacagctttttattgaagttaaaggttactttggagtttgtttggaaatgtgtaaggtcaaatactatagttttcagcatatgtagtacttcagaggaagaattaaggggcatgttggtgcatttaactacaaaaccagaatgattgaagatagtgggaaaagaggaaataccatggcagaaagaagacagctgtttgcagagatgaagatgtgcttagagtgtttgggagagtttcagccaggccttccaatttcctagaccccatgtgtggtactgtgtcttcacctggaattgtgacctttgtgcagttacaaatccaacagagcaaggagcctagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccact

SEQ ID NO: 128747 - DNA, 1508 bp, Homo sapiens
  Payload ID: 5188
  Gene Symbol: DTNA
  Gene Name: dystrobrevin, alpha
  Uniprot ID: Q9Y4J8
  ENST ID: ENST00000596745
  CDS Start-End: 338-1300
gtttcaggatcctcaggaaaccctggtactggcagcagccagcctctgctgtgcccacatgacccacaactctggcagcggacccggcacttccaacattattaaataataagaaagcggctcctactccaggctcaaacctccctgcagaccaatggacaccttctaagagtttggcgagtcagtgactgaagcgcccgtccattccaagataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaactaacagtggaggggcctgccgacctgcggttttctcattgcttttgctctaatgtatgttcatgcttcagtttggaaagagaaaaaagtcatactaatttgcttctttttcaatgtagtgcttgaattgagatatataaatttagcattttttataactatcactactatccacatcaaaagaagaactatgacatcttttagaaaa

SEQ ID NO: 128748 - DNA, 3201 bp, Homo sapiens
  Payload ID: 5188
  Gene Symbol: DTNA
  Gene Name: dystrobrevin, alpha
  Uniprot ID: Q9Y4J8
  ENST ID: ENST00000598334
  CDS Start-End: 327-2501
acagtacacaccaggatctagaggctggatttcatactcatagctctccctagaatttcagagagttctgttatgatctctgttgtaattaccaatttggttcaagtttgttctttaaatgaatatgcttagaattcacatatgttctggatgtactggaattaaaaggatttaagagatcatggtgtgcatgttctaggataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatg

SEQ ID NO: 128749 - DNA, 1931 bp, Homo sapiens
  Payload ID: 5188
  Gene Symbol: DTNA
  Gene Name: dystrobrevin, alpha
  ENST ID: ENST00000601125
  CDS Start-End: 448-1545
ttcatttcatttccccacaggcatgattgaaaagggttgtaagattccaggaatgaactaaatgtttctctgagcccaaatcaactatcatctgaaatcgtggtgcagagaagaaaggtgcaattcctgtaaggctgtatttttccttcttctggttcatacttttgttttcttggtttttcttcacttacttcccccttagtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttcaagaaggaaaaaaaaagacttctgttcaaagttaacttatcagctacatcctctgtaacgtggttcatccctggttaaaaagcaaacaaacacaggctgaaaacccatgctgctgttatacacaat

SEQ ID NO: 128750 - DNA, 2509 bp, Homo sapiens
  Payload ID: 5188
  Gene Symbol: DTNA
  Gene Name: dystrobrevin, alpha
  Uniprot ID: Q9Y4J8
  ENST ID: ENST00000598142
  CDS Start-End: 58-2118
ttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttcaagaaggaaaaaaaaagacttctgttcaaagttaacttatcagctacatcctctgtaacgtggttcatccctggttaaaaagcaaacaaacacaggctgaaaacccatgctgctgttatacacaatggcag

SEQ ID NO: 128751 - DNA, 853 bp, Homo sapiens
  Payload ID: 5188
  Gene Symbol: DTNA
  Gene Name: dystrobrevin, alpha
  ENST ID: ENST00000599844
  CDS Start-End: 279-767
agtattcagtcccccttcctcccactctccaccctactgcgtgctcttacttattctgttggaacccagtgtagcttcctgagatttaaaatataggaagactcaaaactatgttacttcttggaatatagataattcagtactgatttaaataacaactgaatagcaaggaccttctggaacataatcttacattcacaaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaa

SEQ ID NO: 128752 - DNA, 847 bp, Homo sapiens
  Payload ID: 5188
  Gene Symbol: DTNA
  Gene Name: dystrobrevin, alpha
  ENST ID: ENST00000590831
  CDS Start-End: 63-572
agactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaactccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctcca

SEQ ID NO: 128753 - DNA, 1732 bp, Homo sapiens
  Payload ID: 5188
  Gene Symbol: DTNA
  Gene Name: dystrobrevin, alpha
  Uniprot ID: Q9Y4J8
  ENST ID: ENST00000597674
  CDS Start-End: 335-913
gaatatcaaggatggtggcagaattaaagggcaaacttaccttccatcccaggtctagtattcagtcccccttcctcccactctccaccctactgcgtgctcttacttattctgttggaacccagtgtagcttcctgagatttaaaatataggaagactcaaaactatgttacttcttggaatatagataattcagtactgatttaaataacaactgaatagcaaggaccttctggaacataatcttacattcacaaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaactaacagtggaggggcctgccgacctgcggttttctcattgcttttgctctaatgtatgttcatgcttcagtttggaaagagaaaaaagtcatactaatttgcttctttttcaatgtagtgcttgaattgagatatataaatttagcattttttataactatcactactatccacatcaaaagaagaactatgacatcttttagaaaagggaacgaattgtcatttattggaaacattttagatccccagaggtataagtttcaaaccagtcttagcttttcaagttgttgatcagacccttctcttaacagagagataccacagtcactagagataccctgaggttcatgtcatcccaaaacccacagcactcagaagctaacctctacacccactcacactgtgagtattcagttcggtttcattttactgaaaacctgtgaaacctctttttataaaaatcaggcaattaaatcccttttcatcacacaattattgagccttgttccccatggctcaccaaaatgtgctcaattttgtgagagaaagactgtactccataactgactattcacgtcccatctttttggctcttccccaaagcagaatccttactgttggttgacagtaatctctttttaaaaagtaactctcagctttttccttagcaccagagcctttcggctccgggagacgagagggtcattacatacttttttttttttctggaaataggggcattgtgactttatagcctaaactggagctgtctgaacctgtggtcaggctcaagagccagcagggggagcagcaaactc

SEQ ID NO: 128754 - DNA, 2418 bp, Homo sapiens
  Payload ID: 5188
  Gene Symbol: DTNA
  Gene Name: dystrobrevin, alpha
  Uniprot ID: Q9Y4J8
  ENST ID: ENST00000598774
  CDS Start-End: 58-1599
ttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaactaacagtggaggggcctgccgacctgcggttttctcattgcttttgctctaatgtatgttcatgcttcagtttggaaagagaaaaaagtcatactaatttgcttctttttcaatgtagtgcttgaattgagatatataaatttagcattttttataactatcactactatccacatcaaaagaagaactatgacatcttttagaaaagggaacgaattgtcatttattggaaacattttagatccccagaggtataagtttcaaaccagtcttagcttttcaagttgttgatcagacccttctcttaacagagagataccacagtcactagagataccctgaggttcatgtcatcccaaaacccacagcactcagaagctaacctctacacccactcacactgtgagtattcagttcggtttcattttactgaaaacctgtgaaacctctttttataaaaatcaggcaattaaatcccttttcatcacacaattattgagccttgttccccatggctcaccaaaatgtgctcaattttgtgagagaaagactgtactccataactgactattcacgtcccatctttttggctcttccccaaagcagaatccttactgttggttgacagtaatctctttttaaaaagtaactctcagctttttccttagcaccagagcctttcggctccgggagacgagagggtcattacatacttttttttttttctggaaataggggcattgtgactttatagcctaaactggagctgtctgaacctgtggtcaggctcaagagccagcagggggagcagcaaactc

SEQ ID NO: 128755 - DNA, 6016 bp, Homo sapiens
  Payload ID: 5188
  Gene Symbol: DTNA
  Gene Name: dystrobrevin, alpha
  Uniprot ID: Q9Y4J8
  ENST ID: ENST00000595022
  CDS Start-End: 301-2352
ggatttcatactcatagctctccctagaatttcagagagttctgttatgatctctgttgtaattaccaatttggttcaagtttgttctttaaatgaatatgcttagaattcacatatgttctggatgtactggaattaaaaggatttaagagatcatggtgtgcatgttctaggataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttcaagaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaac

SEQ ID NO: 128756 - DNA, 1869 bp, Homo sapiens
  Payload ID: 5188
  Gene Symbol: DTNA
  Gene Name: dystrobrevin, alpha
  Uniprot ID: Q9Y4J8
  ENST ID: ENST00000597599
  CDS Start-End: 151-1683
gaagaatgaacacagctttttattgaagttaaaggttactttggagtttgtttggaaatgtgtaaggtcaaatactatagttttcagcatatgtagtacttcagaggaagaattaaggggcatgttggtgcatttaactacaaaaccagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaactaacagtggaggggcctgccgacctgcggttttctcattgcttttgctctaatgtatgttcatgcttcagtttggaaagagaaaaaagtcatactaatttgcttctttttcaatgtagtgcttgaattgagatatataaatttagcattttttataactatcactactatccacatcaaaagaag

SEQ ID NO: 128757 - DNA, 2464 bp, Homo sapiens
  Payload ID: 5189
  Gene Symbol: DTNB
  Gene Name: dystrobrevin, beta
  ENST ID: ENST00000288642
  CDS Start-End: 264-2126
gcgcgctcgcgctgggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcacc

SEQ ID NO: 128758 - DNA, 822 bp, Homo sapiens
  Payload ID: 5189
  Gene Symbol: DTNB
  Gene Name: dystrobrevin, beta
  ENST ID: ENST00000303659
  CDS Start-End: 258-822
attcaagttgagaattggatggggacacagccaaaccgtatcagggattaatacctgatttctttaatatgaaattgaatattcatgtatattttatgtataagctaactgttcttatgtcctttattacagcctttcattacatttattttctaaattatatttagtaacatgtttatccatataaaacagtagagatatgggaagttacctcaactaatccaggactctgcagagaaaataatcaaagttagaagatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggtt

SEQ ID NO: 128759 - DNA, 565 bp, Homo sapiens
  Payload ID: 5189
  Gene Symbol: DTNB
  Gene Name: dystrobrevin, beta
  ENST ID: ENST00000349996
  CDS Start-End: 169-565
agatcaccccaaatcactgtttcccgaggcgcctaatagcgaacctgtccaggaggtcaccctggacaggaaagaagtgtcccgagacgaggatgccggtgacgaatacttgcccttaaattcctgtgccaggccttgggattaggaagaccttccagctaccgtaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagtta

SEQ ID NO: 128760 - DNA, 1775 bp, Homo sapiens
  Payload ID: 5189
  Gene Symbol: DTNB
  Gene Name: dystrobrevin, beta
  ENST ID: ENST00000356599
  CDS Start-End: 213-404
tcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagagtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcagg

SEQ ID NO: 128761 - DNA, 2160 bp, Homo sapiens
  Payload ID: 5189
  Gene Symbol: DTNB
  Gene Name: dystrobrevin, beta
  ENST ID: ENST00000398951
  CDS Start-End: 167-616
agcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaa

SEQ ID NO: 128762 - DNA, 2474 bp, Homo sapiens
  Payload ID: 5189
  Gene Symbol: DTNB
  Gene Name: dystrobrevin, beta
  Uniprot ID: O60941
  ENST ID: ENST00000406818
  CDS Start-End: 251-2134
gggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaggaagagcaaaagcaggcagctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaa

SEQ ID NO: 128763 - DNA, 2294 bp, Homo sapiens
  Payload ID: 5189
  Gene Symbol: DTNB
  Gene Name: dystrobrevin, beta
  Uniprot ID: O60941
  ENST ID: ENST00000407038
  CDS Start-End: 251-1954
gggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagagtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaggaagagcaaaagcaggcagctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaa

SEQ ID NO: 128764 - DNA, 2273 bp, Homo sapiens
  Payload ID: 5189
  Gene Symbol: DTNB
  Gene Name: dystrobrevin, beta
  Uniprot ID: O60941
  ENST ID: ENST00000405222
  CDS Start-End: 251-1933
gggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagagtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaa

SEQ ID NO: 128765 - DNA, 2420 bp, Homo sapiens
  Payload ID: 5189
  Gene Symbol: DTNB
  Gene Name: dystrobrevin, beta
  Uniprot ID: O60941
  ENST ID: ENST00000407661
  CDS Start-End: 251-2080
gggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaggaagagcaaaagcaggcagctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaa

SEQ ID NO: 128766 - DNA, 2384 bp, Homo sapiens
  Payload ID: 5189
  Gene Symbol: DTNB
  Gene Name: dystrobrevin, beta
  Uniprot ID: O60941
  ENST ID: ENST00000404103
  CDS Start-End: 251-2044
gggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaggaagagcaaaagcaggcagctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaa

SEQ ID NO: 128767 - DNA, 2275 bp, Homo sapiens
  Payload ID: 5189
  Gene Symbol: DTNB
  Gene Name: dystrobrevin, beta
  ENST ID: ENST00000407186
  CDS Start-End: 178-1950
ccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagagtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaa

SEQ ID NO: 128768 - DNA, 2328 bp, Homo sapiens
  Payload ID: 5189
  Gene Symbol: DTNB
  Gene Name: dystrobrevin, beta
  Uniprot ID: O60941
  ENST ID: ENST00000496972
  CDS Start-End: 306-1943
aaacacagtaattcctgatactaagaagaggctggggtgccttaagtaatacgcatgcaggcgttgatggggtagagatctgaagtagtcctgccaagaactgggtttacttctttgtgaatgttactactcttacacagaaacctcatatgaattatcatcctctgacttaaggataacagtcagtctgggagacgtttggtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaagctcttgtgtgtttgtgacctgatgaaacacttcctggcgtctgg

SEQ ID NO: 128769 - DNA, 5522 bp, Homo sapiens
  Payload ID: 5190
  Gene Symbol: DAG1
  Gene Name: dystroglycan 1 (dystrophin-associated glycoprotein 1)
  Uniprot ID: Q14118
  ENST ID: ENST00000308775
  CDS Start-End: 419-3106
aggcagaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctgggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggtcgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaa

SEQ ID NO: 128770 - DNA, 547 bp, Homo sapiens
  Payload ID: 5190
  Gene Symbol: DAG1
  Gene Name: dystroglycan 1 (dystrophin-associated glycoprotein 1)
  ENST ID: ENST00000452317
  CDS Start-End: 425-547
acgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctggatagccctgggatctcctgaatttccaggttgggctactcaggcatggattgactcctacagttcaggcggatggagatcccaccaacccacagcttaattcttcagatgctttatcttcatttctcatgtatcttcagttggcttctaatgctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggac

SEQ ID NO: 128771 - DNA, 549 bp, Homo sapiens
  Payload ID: 5190
  Gene Symbol: DAG1
  Gene Name: dystroglycan 1 (dystrophin-associated glycoprotein 1)
  ENST ID: ENST00000431960
  CDS Start-End: 197-549
cttgcgctcagcgccctctcaccgcccgggccactgctctccaggaagataaggcttttaaagcagcctagcactagaaggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctgga

SEQ ID NO: 128772 - DNA, 841 bp, Homo sapiens
  Payload ID: 5190
  Gene Symbol: DAG1
  Gene Name: dystroglycan 1 (dystrophin-associated glycoprotein 1)
  ENST ID: ENST00000428779
  CDS Start-End: 555-841
cgcggcgctcgcgcctcttaggcttggcggtggcggcggcggcagcttcgcgccgaatccccggggagcggcggtggcggcgtcctggggccaggaggagcgaacacctgccgcggtcctcccgccggcgctggacctggttcacctgcgagtgtatttggatagtgtctccacagaaaatgtcgtctcggcttggaatctttttgccataaattctaaggccactgctctccaggaagataaggcttttaaagcagcctagcactagaaggtgaggcacacgactgtctatcccagatggctgcactggcctaggacagacggttcttcccccagtacgtcaagaccctggagggtgcaagctacagaacagctgggctcctgcattcctcccagaccctgtcttcagtaggacaacaggcaacaaacttaaatttggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggt

SEQ ID NO: 128773 - DNA, 397 bp, Homo sapiens
  Payload ID: 5190
  Gene Symbol: DAG1
  Gene Name: dystroglycan 1 (dystrophin-associated glycoprotein 1)
  ENST ID: ENST00000430636
  CDS Start-End: 372-397
aggcttggcggtggcggcggcggcagcttcgcgccgaatccccggggagcggcggtggcggcgtcctggggccaggaggagcgaacacctgccgcggtcctcccgccggcgctgggtgagtgcaccgcccgccctatccgctgtgcctggctgcttgggcccccatccctgctgccggctgagccttccgcggaacacctgctgctgctcgctgttcggcccggggcggggacacggccgcggacgtccttgtgggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgct

SEQ ID NO: 128774 - DNA, 562 bp, Homo sapiens
  Payload ID: 5190
  Gene Symbol: DAG1
  Gene Name: dystroglycan 1 (dystrophin-associated glycoprotein 1)
  ENST ID: ENST00000419218
  CDS Start-End: 517-562
cttaggcttggcggtggcggcggcggcagcttcgcgccgaatccccggggagcggcggtggcggcgtcctggggccaggaggagcgaacacctgccgcggtcctcccgccggcgctgggcacacgactgtctatcccagatggctgcactggcctaggacagacggttcttcccccagtacgtcaagaccctggagggtgcaagctacagaacagctgggctcctgcattcctcccagaccctgtcttcagtaggacaacaggcaacaaacttaaatttgggattctcattctgtctcccatgctggagtgcagtggcgcggtcttggctcactgaaacctttgcttcccagggtcaagcgattcccctgcctcagcttcctgagtagctgggattacaggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcgggga

SEQ ID NO: 128775 - DNA, 731 bp, Homo sapiens
  Payload ID: 5190
  Gene Symbol: DAG1
  Gene Name: dystroglycan 1 (dystrophin-associated glycoprotein 1)
  ENST ID: ENST00000418588
  CDS Start-End: 467-731
agaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctggggccactgctctccaggaagataaggcttttaaagcagcctagcactagaaggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcct

SEQ ID NO: 128776 - DNA, 588 bp, Homo sapiens
  Payload ID: 5190
  Gene Symbol: DAG1
  Gene Name: dystroglycan 1 (dystrophin-associated glycoprotein 1)
  ENST ID: ENST00000452060
  CDS Start-End: 329-588
gtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctggggccactgctctccaggaagataaggcttttaaagcagcctagcactagaaggtgaggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgat

SEQ ID NO: 128777 - DNA, 579 bp, Homo sapiens
  Payload ID: 5190
  Gene Symbol: DAG1
  Gene Name: dystroglycan 1 (dystrophin-associated glycoprotein 1)
  ENST ID: ENST00000421560
  CDS Start-End: 260-579
aggcagaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttg

SEQ ID NO: 128778 - DNA, 624 bp, Homo sapiens
  Payload ID: 5190
  Gene Symbol: DAG1
  Gene Name: dystroglycan 1 (dystrophin-associated glycoprotein 1)
  ENST ID: ENST00000435508
  CDS Start-End: 394-550
acgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctggggattctcattctgtctcccatgctggagtgcagtggcgcggtcttggctcactgaaacctttgcttcccagggtcaagcgattcccctgcctcagcttcctgagtagctgggattacaggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctca

SEQ ID NO: 128779 - DNA, 5582 bp, Homo sapiens
  Payload ID: 5190
  Gene Symbol: DAG1
  Gene Name: dystroglycan 1 (dystrophin-associated glycoprotein 1)
  Uniprot ID: Q14118
  ENST ID: ENST00000538711
  CDS Start-End: 476-3163
aggcagaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctggggccactgctctccaggaagataaggcttttaaagcagcctagcactagaaggtgaggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggtcgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaacgc

SEQ ID NO: 128780 - DNA, 5665 bp, Homo sapiens
  Payload ID: 5190
  Gene Symbol: DAG1
  Gene Name: dystroglycan 1 (dystrophin-associated glycoprotein 1)
  Uniprot ID: Q14118
  ENST ID: ENST00000539901
  CDS Start-End: 559-3246
aggcagaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctgggtgagtgcaccgcccgccctatccgctgtgcctggctgcttgggcccccatccctgctgccggctgagccttccgcggaacacctgctgctgctcgctgttcggcccggggcggggacacggccgcggacgtccttgtgggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggtcgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaacgc

SEQ ID NO: 128781 - DNA, 5676 bp, Homo sapiens
  Payload ID: 5190
  Gene Symbol: DAG1
  Gene Name: dystroglycan 1 (dystrophin-associated glycoprotein 1)
  Uniprot ID: Q14118
  ENST ID: ENST00000541308
  CDS Start-End: 570-3257
aggcagaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctggatagccctgggatctcctgaatttccaggttgggctactcaggcatggattgactcctacagttcaggcggatggagatcccaccaacccacagcttaattcttcagatgctttatcttcatttctcatgtatcttcagttggcttctaatgctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggtcgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaacgc

SEQ ID NO: 128782 - DNA, 5576 bp, Homo sapiens
  Payload ID: 5190
  Gene Symbol: DAG1
  Gene Name: dystroglycan 1 (dystrophin-associated glycoprotein 1)
  Uniprot ID: Q14118
  ENST ID: ENST00000515359
  CDS Start-End: 470-3157
ttttttgtatttttagtagagacggggtttcacgttgttggtcaggctggtctcaaactcctgacctcaggtgatccacccgccttggcctcccaaagtgctgggattacaggtgtgagccaccgcggctggtcaaaattttttttttttggtactttttttgcagaggcggggtttcgacacgttgcccaggctggtcttgaactcctgagctcaagctatccatccacctgcctcggcctcccatagtgctgggactacaggcgggagcacagcacctagccccttccttttcttgtctctgtgaatgaggtttggagccgagacactgaagtatagataattgcaaaaaggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggtcgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaacgc

SEQ ID NO: 128783 - DNA, 5829 bp, Homo sapiens
  Payload ID: 5190
  Gene Symbol: DAG1
  Gene Name: dystroglycan 1 (dystrophin-associated glycoprotein 1)
  Uniprot ID: Q14118
  ENST ID: ENST00000545947
  CDS Start-End: 723-3410
aggcagaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctggacctggttcacctgcgagtgtatttggatagtgtctccacagaaaatgtcgtctcggcttggaatctttttgccataaattctaaggccactgctctccaggaagataaggcttttaaagcagcctagcactagaaggtgaggcacacgactgtctatcccagatggctgcactggcctaggacagacggttcttcccccagtacgtcaagaccctggagggtgcaagctacagaacagctgggctcctgcattcctcccagaccctgtcttcagtaggacaacaggcaacaaacttaaatttggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggtcgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaacgc

SEQ ID NO: 128784 - DNA, 3305 bp, Homo sapiens
  Payload ID: 5191
  Gene Symbol: DMWD
  Gene Name: dystrophia myotonica, WD repeat containing
  Uniprot ID: Q09019
  ENST ID: ENST00000270223
  CDS Start-End: 47-2071
ctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccccccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctggg

SEQ ID NO: 128785 - DNA, 3292 bp, Homo sapiens
  Payload ID: 5191
  Gene Symbol: DMWD
  Gene Name: dystrophia myotonica, WD repeat containing
  ENST ID: ENST00000377735
  CDS Start-End: 47-1996
ctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccccccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaaagctggtataaagcagagagcctgagggctaaatttaa

SEQ ID NO: 128786 - DNA, 843 bp, Homo sapiens
  Payload ID: 5191
  Gene Symbol: DMWD
  Gene Name: dystrophia myotonica, WD repeat containing
  ENST ID: ENST00000537879
  CDS Start-End: 1-195
gaggactgcatcatcactgcctgccaggagggcctcatctgcacctgggcccggccgggcaaggcgttcacagacgaggagaccgaggcccagacaggggaaggaagttggcccaggtcacccagcaagtcagtggtagaggtaggactgtccctgagttctttccccagcacctcagggtccctcccaagttagaagggagctccagtttccccctcccctcccacccttacccttaccccatggtctcactcaggatccgccaaggactttgattattgcgtgaaagtgctgactgccaggacaggaagctagctaagatgcaagttcccagcctagagcagtggcctctggggggtctagggcggacccaagggcaaggccagggtggcagcagctttggggactctgggctggctccctccccttgacactggctgaagcccaggtggtctctaacccctcccatctctccctctcatcttccccagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagact

SEQ ID NO: 128787 - DNA, 655 bp, Homo sapiens
  Payload ID: 5191
  Gene Symbol: DMWD
  Gene Name: dystrophia myotonica, WD repeat containing
  ENST ID: ENST00000602829
  CDS Start-End: 1-485
aggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcggtgagtggccccacaccagcctgccggggacctggcaggacctttcgtgggaagaggcaggcattggcagagagagggctttgttgctgtcacagcctctggctccgtggggtgaggggaagccagggaaatcttagtgtctcagtacaagacctctcagatccttagagtgagggggtctagccctaggcagcaggcagcagaaagaggggtgggtgtgagagccagctaggaattggggcatccaaggctggccgtctgaagggcagcagatgggccccacatggccaggtcttactgcctgtcactcgaaccagaatctatttctgttgaacatc

SEQ ID NO: 128788 - DNA, 643 bp, Homo sapiens
  Payload ID: 5191
  Gene Symbol: DMWD
  Gene Name: dystrophia myotonica, WD repeat containing
  ENST ID: ENST00000598237
  CDS Start-End: 1-449
ccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggaggtgattgcagcccccagagcccccaacttctctgccttctcacctacccactatatgccattaggatgcagctgcctgcggaacagtgtaggcctgagaggggcaggaccagggagagatggagaatggggtgacagcagctaatgacagctgcctttactgtacccaggccctgtgctgtgttacccttgtgctgaatactttactccttgggttttctttctttctttctttcttttatttatttattttgagatggagtctcaccctgtcacccaggctggagtgcagtggcgcgatctctgctcactgcaagatccacctcccgggttcatgcc

SEQ ID NO: 128789 - DNA, 370 bp, Homo sapiens
  Payload ID: 5191
  Gene Symbol: DMWD
  Gene Name: dystrophia myotonica, WD repeat containing
  ENST ID: ENST00000597053
  CDS Start-End: 1-309
ggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggaggaccgctgttgtagaatcatacatggagattgctcagtcctgggccaacttggcctacgaggagataccagtaaacgaccttatccgcgggcagggactgctcttggcttctgtctcattctctctggtccagaggaggtgttccataaatattctcagaatgagtgaatggctgaagggagtgaacggaacagtcagtggattaaaaattcattagctcatccattca

SEQ ID NO: 128790 - DNA, 2787 bp, Homo sapiens
  Payload ID: 5192
  Gene Symbol: DMPK
  Gene Name: dystrophia myotonica-protein kinase
  Uniprot ID: Q09013
  ENST ID: ENST00000291270
  CDS Start-End: 127-2016
gggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctgctgctgctgctgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaa

SEQ ID NO: 128791 - DNA, 3227 bp, Homo sapiens
  Payload ID: 5192
  Gene Symbol: DMPK
  Gene Name: dystrophia myotonica-protein kinase
  Uniprot ID: Q09013
  ENST ID: ENST00000343373
  CDS Start-End: 545-2464
gccacaagcctccaccccagctggtcccccacccaggctgcccagtttaacattcctagtcataggaccttgacttctgagaggcctgattgtcatctgtaaataaggggtaggactaaagcactcctcctggaggactgagagatgggctggaccggagcacttgagtctgggatatgtgaccatgctacctttgtctccctgtcctgttccttcccccagccccaaatccagggttttccaaagtgtggttcaagaaccacctgcatctgaatctagaggtactggatacaaccccacgtctgggccgttacccaggacattctacatgagaacgtgggggtggggccctggctgcacctgaactgtcacctggagtcagggtggaaggtggaagaactgggtcttatttccttctccccttgttctttagggtctgtccttctgcagactccgttaccccaccctaaccatcctgcacacccttggagccctctgggccaatgccctgtcccgcaaagggcttctcaggcatctcacctctatgggagggcatttttggcccccagaaccttacacggtgtttatgtggggaagcccctgggaagcagacagtcctagggtgaagctgagaggcagagagaaggggagacagacagagggtggggctttcccccttgtctccagtgccctttctggtgaccctcggttcttttcccccaccacccccccagcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctgctgctgctgctgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatc

SEQ ID NO: 128792 - DNA, 1982 bp, Homo sapiens
  Payload ID: 5192
  Gene Symbol: DMPK
  Gene Name: dystrophia myotonica-protein kinase
  Uniprot ID: Q09013
  ENST ID: ENST00000354227
  CDS Start-End: 138-1730
gagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacaggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgt

SEQ ID NO: 128793 - DNA, 2548 bp, Homo sapiens
  Payload ID: 5192
  Gene Symbol: DMPK
  Gene Name: dystrophia myotonica-protein kinase
  Uniprot ID: Q09013
  ENST ID: ENST00000458663
  CDS Start-End: 37-1914
cggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctgctgctgctgctgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacag

SEQ ID NO: 128794 - DNA, 2754 bp, Homo sapiens
  Payload ID: 5192
  Gene Symbol: DMPK
  Gene Name: dystrophia myotonica-protein kinase
  Uniprot ID: Q09013
  ENST ID: ENST00000447742
  CDS Start-End: 128-2002
ggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctgctgctgctgctgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaa

SEQ ID NO: 128795 - DNA, 2920 bp, Homo sapiens
  Payload ID: 5192
  Gene Symbol: DMPK
  Gene Name: dystrophia myotonica-protein kinase
  ENST ID: ENST00000588522
  CDS Start-End: 201-437
ggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggccccaaatccagggttttccaaagtgtggttcaagaaccacctgcatctgaatctagagcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctgctgctgctgctgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaa

SEQ ID NO: 128796 - DNA, 548 bp, Homo sapiens
  Payload ID: 5192
  Gene Symbol: DMPK
  Gene Name: dystrophia myotonica-protein kinase
  ENST ID: ENST00000593574
  CDS Start-End: 1-548
cgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacatcaactacgcgaggcagaggctcggaaccgggacctagaggcacacgtccggcagttgcaggagcggatggagttgctgcaggcagagggagccacaggtccctaggcctggcctatcggaggcgctttccctgctcctgttcgccgttgttctgtctcgtgccgccgccctgggctgcattgggttggtggcccacgccggccaactcaccgcagtctggcgccgccc
